United States Patent
Dahary et al.

(10) Patent No.: US 7,368,548 B2
(45) Date of Patent: May 6, 2008

(54) NUCLEOTIDE AND AMINO ACID SEQUENCES, AND ASSAYS AND METHODS OF USE THEREOF FOR DIAGNOSIS OF PROSTATE CANCER

(75) Inventors: Dvir Dahary, Tel-Aviv (IL); Sarah Pollock, Tel-Aviv (IL); Zurit Levine, Herzlia (IL); Rotem Sorek, Rechovot (IL); Michal Ayalon-Soffer, Ramat-HaSharon (IL); Pinchas Akiva, Ramat-Gan (IL); Amir Toporik, Azur (IL); Osnat Sella-Tavor, Kfar Kish (IL); Shirley Sameah-Greenwald, Kfar-Saba (IL)

(73) Assignee: Compugen Ltd., Tel Aviv (IL)

( * ) Notice: Subject to any disclaimer, the term of this patent is extended or adjusted under 35 U.S.C. 154(b) by 120 days.

(21) Appl. No.: 11/043,806

(22) Filed: Jan. 27, 2005

(65) Prior Publication Data

US 2006/0051774 A1    Mar. 9, 2006

Related U.S. Application Data

(60) Provisional application No. 60/628,251, filed on Nov. 17, 2004, provisional application No. 60/628,231, filed on Nov. 17, 2004, provisional application No. 60/628,179, filed on Nov. 17, 2004, provisional application No. 60/628,178, filed on Nov. 17, 2004, provisional application No. 60/628,167, filed on Nov. 17, 2004, provisional application No. 60/628,156, filed on Nov. 17, 2004, provisional application No. 60/628,145, filed on Nov. 17, 2004, provisional application No. 60/628,134, filed on Nov. 17, 2004, provisional application No. 60/628,123, filed on Nov. 17, 2004, provisional application No. 60/628,112, filed on Nov. 17, 2004, provisional application No. 60/628,101, filed on Nov. 17, 2004, provisional application No. 60/621,131, filed on Oct. 25, 2004, provisional application No. 60/620,918, filed on Oct. 22, 2004, provisional application No. 60/620,916, filed on Oct. 22, 2004, provisional application No. 60/620,874, filed on Oct. 22, 2004, provisional application No. 60/620,853, filed on Oct. 22, 2004, provisional application No. 60/620,677, filed on Oct. 22, 2004, provisional application No. 60/620,656, filed on Oct. 22, 2004, provisional application No. 60/539,129, filed on Jan. 27, 2004, provisional application No. 60/539,128, filed on Jan. 27, 2004.

(51) Int. Cl.
*C07H 21/02* (2006.01)
*C07H 21/04* (2006.01)

(52) U.S. Cl. .................................. 536/23.1; 536/24.33

(58) Field of Classification Search ................ 530/300, 530/350; 536/23.1
See application file for complete search history.

(56) References Cited

U.S. PATENT DOCUMENTS

2004/0181048 A1*  9/2004  Wang ....................... 536/24.3

OTHER PUBLICATIONS

The 1997/1998 Stratagene catalog (p. 118, 1997/1998).*
Tomohiro Otani, Tetsuya Miyzaki, Shu Yamamoto, "40 Gbit/s Signal Transmission using Optical 3R Regenerator based on Electroabsorption Modulators," IEEE Photonics Technology Letters, Optical Fiber Communications Conf., 2000, pp. 226-228.
G. Raybon, B. Mikkelsen U. Koren, B.I. Miller, K. Dreyer, L. Boivin, S. Chandrasekhar, C.A. Burrus, "20 Gbit/s all-optical regeneration and wavelength conversion using SOA based interferometers," IEEE Photonics Technology Letters, Optical Fiber Communications Conf., 1999, pp. 27-29.

* cited by examiner

*Primary Examiner*—Shanon Foley
*Assistant Examiner*—Sean E Aeder
(74) *Attorney, Agent, or Firm*—Staas & Halsey LLP

(57) ABSTRACT

Novel markers for prostate cancer that are both sensitive and accurate. Furthermore, these markers are able to distinguish between prostate cancer and benign prostate hyperplasia ("BPH"). These markers are overexpressed in prostate cancer specifically, as opposed to normal prostate tissue and/or BPH. The measurement of these markers, alone or in combination, in patient samples provides information that the diagnostician can correlate with a probable diagnosis of prostate cancer. The markers of the present invention, alone or in combination, show a high degree of differential detection between prostate cancer and non-cancerous states.

4 Claims, 20 Drawing Sheets
(20 of 20 Drawing Sheet(s) Filed in Color)

$C_T$ = Threshold Cycle point – A calculated cycle number in which PCR products signal is above the background level (passive dye ROX) and still in the Geometric/Expo phase.

- 3-D surface chemistry comprised of a long-chain, hydrophilic polymer.
- The Codelink surface allows lower background, high sensitivity and reproducibility.

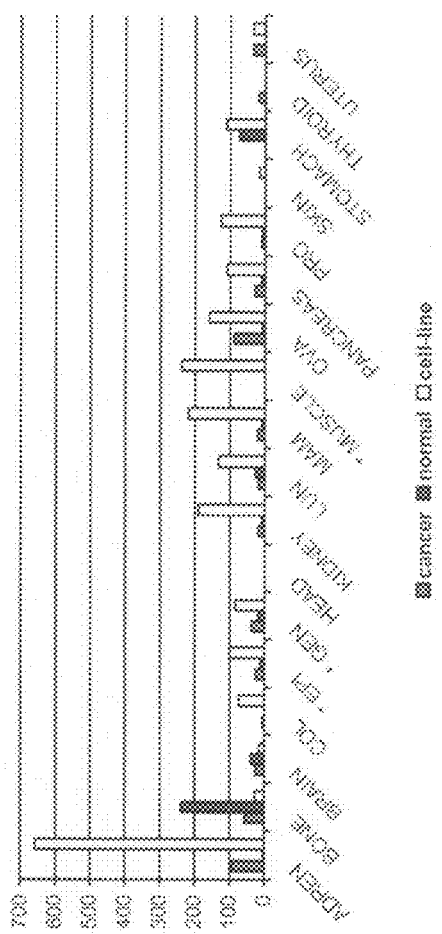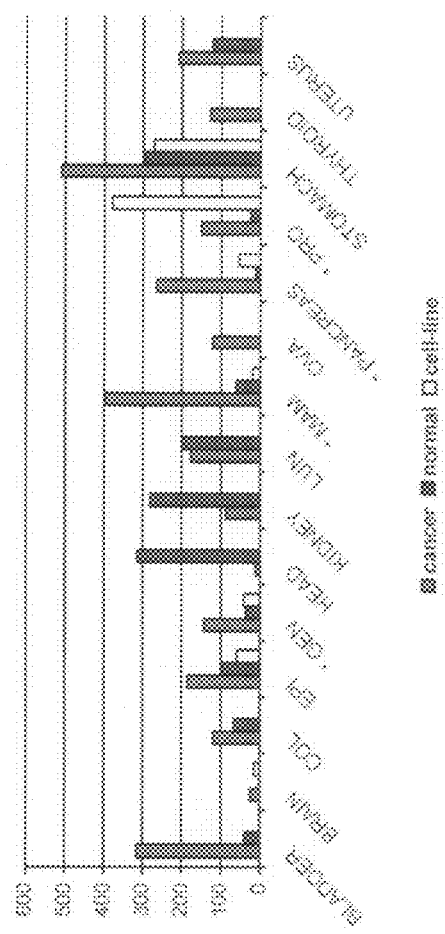

NUCLEOTIDE AND AMINO ACID SEQUENCES, AND ASSAYS AND METHODS OF USE THEREOF FOR DIAGNOSIS OF PROSTATE CANCER

CROSS-REFERENCE TO RELATED APPLICATION(S)

This application is related to Novel Nucleotide and Amino Acid Sequences, and Assays and Methods of use thereof for Diagnosis of Prostate Cancer, and claims priority to the below U.S. provisional applications which are incorporated by reference herein: Application No. 60/620,916 filed Oct. 22, 2004—Differential Expression of Markers in Colon Cancer; Application No. 60/628,123 filed Nov. 17, 2004—Differential Expression of Markers in Colon Cancer II; Application No. 60/621,131 filed Oct. 25, 2004—Diagnostic Markers for Colon Cancer, and Assays and Methods of use thereof; Application No. 60/628,101 filed Nov. 17, 2004—Differential Expression of Markers in Breast Cancer II; Application No. 60/620,874 filed Oct. 22, 2004—Differential Expression of Markers in Ovarian Cancer; Application No. 60/628,134 filed Nov. 17, 2004—Differential Expression of Markers in Ovarian Cancer II; Application No. 60/620,853 filed Oct. 22, 2004—Differential Expression of Markers in Lung Cancer; Application No. 60/628,112 filed Nov. 17, 2004—Differential Expression of Markers in Lung Cancer II; Application No. 60/628,145 filed Nov. 17, 2004—Differential Expression of Markers in Pancreatic Cancer II; Application No. 60/620,656 filed Oct. 22, 2004—Differential Expression of Markers in Prostate Cancer; Application No. 60/628,251 filed Nov. 17, 2004—Differential Expression of Markers in Prostate Cancer II; Application No. 60/628,178 filed Nov. 17, 2004—Differential Expression of Markers in Brain Cancer II; Application No. 60/628,231 filed Nov. 17, 2004—Novel Diagnostic Serum Markers, and Assays and Methods of use thereof; Application No. 60/620,918 filed Oct. 22, 2004—Diagnostic Markers for Renal Cancer, and Assays and Methods of Use thereof. Application No. 60/628,156 filed Nov. 17, 2004—Diagnostic Markers for Renal Cancer, and Assays and Methods of Use thereof II; Application No. 60/620,677 filed Oct. 22, 2004—Differential Expression of Markers in Bladder Cancer I; Application No. 60/628,167 filed Nov. 17, 2004—Differential Expression of Markers in Bladder Cancer II; Application Ser. No. 60/628,179 filed Nov. 17, 2004—Novel Diagnostic Markers, and Assays and Methods of Use thereof. Application No. 60/539,129 filed Jan. 27, 2004—Methods and Systems for Annotating Biomolecular Sequences Application No. 60/539,128 filed Jan. 27, 2004—Evolutionary Conserved Spliced Sequences and Methods and Systems for Identifying thereof.

FIELD OF THE INVENTION

The present invention is related to novel nucleotide and protein sequences that are diagnostic markers for prostate cancer, and assays and methods of use thereof.

BACKGROUND OF THE INVENTION

Prostate cancer is the most commonly diagnosed malignancy and the second most frequent cause of cancer-related deaths in the western male population. Prostate cancer therapies are most effective in the earlier stages of the disease, before metastasis has occurred. Treatment is expected to be even more effective before significant local growth of the cancerous tissue has taken place. Therefore, efforts to control the disease (i.e., to decrease prostate cancer mortality) have focused on increasing detection of the cancer while it is still locally confined and potentially curable, through diagnostic assays that are suitable for early detection of prostate cancer. Unfortunately, such detection also has significant drawbacks, because diagnostic assays that use currently available prostate cancer markers lead to high numbers of false positive diagnoses, and/or are not sufficiently sensitive (potentially leading to high numbers of false negative diagnoses).

Measurements of serum concentrations of prostatic marker enzymes have recognized value in the clinical detection, diagnosis and management of prostate cancer. The two most widely used prostatic marker enzymes are prostatic acid phosphatase (PAP) and prostate-specific antigen (PSA). Normally, both enzymes are secreted from the prostatic epithelial cells into the seminal fluid, but in patients with prostatic disease they leak into the circulation, where they can be detected by means of immunological assays (Armbruster, Clin. Che. 39:181-95 (1993)).

Prostatic acid phosphatase, one of the earliest serum markers for prostate, has an as yet undetermined function and is one of the most predominant protein components in human prostatic secretions. The use of PAP as a marker for prostatic tumors is complicated by the reported structural similarities between the prostate-specific acid phosphatase and the lysosomal acid phosphatase occurring in all tissues. Furthermore, there is a tendency towards lower PAP mRNA and protein levels in prostate cancer in comparison with benign prostatic hyperplasia (BPH). In recent years, PAP measurements were superseded by serum PSA measurements in the clinical management of prostate cancer.

Prostate-specific antigen (PSA) was identified by several groups as a prostate-specific protein from the seminal fluid, and was subsequently determined to be an antigen from prostate cancer tissue. PSA is produced exclusively by the columnar epithelial cells of the prostate and periuretural glands. Normal prostate epithelium and benign hyperplastic tissue actually produce more PSA mRNA and protein than does prostate cancer tissue. Furthermore, it was shown that loss of differentiation of prostatic carcinomas is associated with a decrease in the level of intraprostatic PSA.

Prostate-specific membrane antigen (PSM) was originally identified using an antibody developed by immunizing mice with the membrane fraction of LNCaP human prostatic adenocarcinoma cells. Like PAP and PSA, PSM can be detected in normal prostate, BPH and prostate cancer and is absent from most other tissues. However, the usefulness of PSM as marker for prostatic cancer has not been fully established.

Other markers have recently been considered. For example, PCA3 DD3 is a new marker from DiagnoCure, which has been described as being useful in a urine-based test (PCA3 itself is described in PCT Application Nos. WO 98/45420 and WO 2000/123550). This marker is apparently only expressed in prostate cancer, and therefore may be used to distinguish between BPH and prostate cancer. However, as described in greater detail below, the sensitivity and accuracy of this marker may be improved when used in combination with one or more additional markers.

Therefore, PSA is recognized as the best available marker for prostate cancer, being useful for screening selected populations of patients with symptoms indicative of prostate cancer and for monitoring patients after therapy, especially after surgical prostatectomy. However, PSA has significant drawbacks in terms of false positive measurements, since it cannot distinguish prostate cancer from BPH. It may also lead to false negative measurements, since de-differentiation of prostate cancerous tissue (which may occur with some types of prostate cancers) also leads to decreased expression of this marker. New markers are currently being developed to overcome this problem, but these markers have their own drawbacks. Clearly, new markers are required.

SUMMARY OF THE INVENTION

The background art does not teach or suggest markers for prostate cancer that are sufficiently sensitive and/or accurate, alone or in combination.

The present invention overcomes these deficiencies of the background art by providing novel markers for prostate cancer that are both sensitive and accurate. Furthermore, at least some of these markers are able to distinguish between prostate cancer and benign prostate hyperplasia ("BPH"). These markers are differentially expressed, and preferably overexpressed in prostate cancer specifically, as opposed to normal prostate tissue and/or BPH. The measurement of these markers, alone or in combination, in patient samples (biological samples) provides information that the diagnostician can correlate with a probable diagnosis of prostate cancer. The markers of the present invention, alone or in combination, show a high degree of differential detection between prostate cancer and non-cancerous states.

According to preferred embodiments of the present invention, examples of suitable biological samples include but are not limited to blood, serum, plasma, blood cells, urine, sputum, saliva, stool, spinal fluid or CSF, lymph fluid, the external secretions of the skin, respiratory, intestinal, and genitourinary tracts, tears, milk, neuronal tissue, prostate tissue or mucous and any human organ or tissue, or any sample obtained by lavage (for example of the bronchial system), and also samples of in vivo cell culture constituents. In a preferred embodiment, the biological sample comprises prostate tissue and/or other tissues of the male genitalia, or reproductive or urinary tracts, and/or a serum (and/or any blood) sample and/or a urine sample and/or a semen sample and/or any other tissue or liquid sample. The sample can optionally be diluted with a suitable eluant before contacting the sample to an antibody and/or performing any other diagnostic assay.

Information given in the text with regard to cellular localization was determined according to four different software programs: (i) tmhmm (from Center for Biological Sequence Analysis, Technical University of Denmark DTU, cbsdot dtudot dk/services/TMHMM/TMHMM2dot 0bdot guidedot php) or (ii) tmpred (from EMBnet, maintained by the ISREC Bionformatics group and the LICR Information Technology Office, Ludwig Institute for Cancer Research, Swiss Institute of Bioinformatics, chdot embnetdot org/ software/TMPRED_formdot html) for transmembrane region prediction; (iii) signalp_hmm or (iv) signalp_nn (both from Center for Biological Sequence Analysis, Technical University of Denmark DTU, cbsdot dtudot dk/services/ SignalP/background/predictiondot php) for signal peptide prediction. The terms "signalp_hmm" and "signalp_nn" refer to two modes of operation for the program SignalP: hmm refers to Hidden Markov Model, while nn refers to neural networks. Localization was also determined through manual inspection of known protein localization and/or gene structure, and the use of heuristics by the individual inventor. In some cases for the manual inspection of cellular localization prediction inventors used the ProLoc computational platform [Einat Hazkani-Covo, Erez Levanon, Galit Rotman, Dan Graur and Amit Novik; (2004) "Evolution of multicellularity in metazoa: comparative analysis of the subcellular localization of proteins in *Saccharomyces, Drosophila* and *Caenorhabditis*." Cell Biology International 2004;28(3):171-8.], which predicts protein localization based on various parameters including, protein domains (e.g., prediction of trans-membranous regions and localization thereof within the protein), pI, protein length, amino acid composition, homology to pre-annotated proteins, recognition of sequence patterns which direct the protein to a certain organelle (such as, nuclear localization signal, NLS, mitochondria localization signal), signal peptide and anchor modeling and using unique domains from Pfam that are specific to a single compartment.

Information is given in the text with regard to SNPs (single nucleotide polymorphisms). A description of the abbreviations is as follows. "T->C", for example, means that the SNP results in a change at the position given in the table from T to C. Similarly, "M->Q", for example, means that the SNP has caused a change in the corresponding amino acid sequence, from methionine (M) to glutamine (Q). If, in place of a letter at the right hand side for the nucleotide sequence SNP, there is a space, it indicates that a frameshift has occurred. A frameshift may also be indicated with a hyphen (-). A stop codon is indicated with an asterisk at the right hand side (*). As part of the description of an SNP, a comment may be found in parentheses after the above description of the SNP itself. This comment may include an FTId, which is an identifier to a SwissProt entry that was created with the indicated SNP. An FTId is a unique and stable feature identifier, which allows construction of links directly from position-specific annotation in the feature table to specialized protein-related databases. The FTId is always the last component of a feature in the description field, as follows: FTId=XXX_number, in which XXX is the 3-letter code for the specific feature key, separated by an underscore from a 6-digit number. In the table of the amino acid mutations of the wild type proteins of the selected splice variants of the invention, the header of the first column is "SNP position(s) on amino acid sequence", representing a position of a known mutation on amino acid sequence.

SNPs may optionally be used as diagnostic markers according to the present invention, alone or in combination with one or more other SNPs and/or any other diagnostic marker. Preferred embodiments of the present invention comprise such SNPs, including but not limited to novel SNPs on the known (WT or wild type) protein sequences given below, as well as novel nucleic acid and/or amino acid sequences formed through such SNPs, and/or any SNP on a variant amino acid and/or nucleic acid sequence described herein.

Information given in the text with regard to the Homology to the known proteins was determined by Smith-Waterman version 5.1.2 using special (non default) parameters as follows:

model=sw.model
GAPEXT=0
GAPOP=100.0
  MATRIX=blosum 100

Information is given with regard to overexpression of a cluster in cancer based on ESTs. A key to the p values with regard to the analysis of such overexpression is as follows:

library-based statistics: P-value without including the level of expression in cell-lines (P1)

library based statistics: P-value including the level of expression in cell-lines (P2)

EST clone statistics: P-value without including the level of expression in cell-lines (SP1)

EST clone statistics: predicted overexpression ratio without including the level of expression in cell-lines (R3)

EST clone statistics: P-value including the level of expression in cell-lines (SP2)

EST clone statistics: predicted overexpression ratio including the level of expression in cell-lines (R4)

Library-based statistics refer to statistics over an entire library, while EST clone statistics refer to expression only for ESTs from a particular tissue or cancer.

Information is given with regard to overexpression of a cluster in cancer based on microarrays. As a microarray reference, in the specific segment paragraphs, the unabbreviated tissue name was used as the reference to the type of chip for which expression was measured. There are two types of microarray results: those from microarrays prepared according to a design by the present inventors, for which the microarray fabrication procedure is described in detail in Materials and Experimental Procedures section herein; and those results from microarrays using Affymetrix technology. As a microarray reference, in the specific segment paragraphs, the unabbreviated tissue name was used as the reference to the type of chip for which expression was measured. For microarrays prepared according to a design by the present inventors, the probe name begins with the name of the cluster (gene), followed by an identifying number. Oligonucleotide microarray results taken from Affymetrix data were from chips available from Affymetrix Inc, Santa Clara, Calif., USA (see for example data regarding the Human Genome U133 (HG-U133) Set at affymetrixdot com/products/arrays/specific/hgu 133dot affx; GeneChip Human Genome U133A 2.0 Array at affymetrixdot com/products/arrays/specific/hgu133av2dot affx; and Human Genome U133 Plus 2.0 Array ataffymetrixdot com/products/arrays/specific/hgu133plusdot affx). The probe names follow the Affymetrix naming convention. The data is available from NCBI Gene Expression Omnibus (see ncbidot nlmdot nihdot gov/projects/geo/ and Edgar et al, Nucleic Acids Research, 2002, Vol. 30, No. 1 207-210). The dataset (including results) is available from ncbidot nlmdot nihdot gov/geo/query/accdot cgi?acc=GSE1133 for the Series GSE1133 database (published on March 2004); a reference to these results is as follows: Su et al (Proc Natl Acad Sci U S A. 2004 Apr. 20;101(16):6062-7. Epub 2004 Apr. 09). A list of probes designed according to the present inventors is given below.

>H53626_0_16_0
(SEQ ID NO:520)
ATGCGGGCATGTACATCTGCCTTGGCGCCAACACCATGGGCTACAGCTTC

>H53626_0_0_8391
(SEQ ID NO:521)
GGGTCTGGGGTGCTCTCCTGGTCTTTGTGTCGGCGTTCCCCTCCCTACCT

>HSMUC1A_0_37_0
(SEQ ID NO:522)
AAAAGGAGACTTCGGCTACCCAGAGAAGTTCAGTGCCCAGCTCTACTGAG

>HSMUC1A_0_0_11364
(SEQ ID NO:523)
AAAGGCTGGCATAGGGGGAGGTTTCCCAGGTAGAAGAAGAAGTGTCAGCA

>HSMUC1A_0_0_11365
(SEQ ID NO:524)
AATTAACCCTTTGAGAGCTGGCCAGGACTCTGGACTGATTACCCCAGCCT

>HSSTROL3_0_0_12518

(SEQ ID NO:525)
ATGAGAGTAACCTCACCCGTGCACTAGTTTACAGAGCATTCACTGCCCCA

>HSSTROL3_0_0_12517
(SEQ ID NO:526)
CAGAGATGAGAGCCTGGAGCATTGCAGATGCCAGGGACTTCACAAATGAA

>HSCOC4_0_0_9892
(SEQ ID NO:527)
AAGGACCAGAGTCCATGCCAAGACCACCCTTCAGCTTCCAAGGCCCTCCA

>HSCOC4_0_39_0
(SEQ ID NO:528)
ATCCTCCAGCCATGAGGCTGCTCTGGGGGCTGATCTGGGCATCCAGCTTC

>HSCOC4_0_0_9883
(SEQ ID NO:539)
CCTGTTTGCTCTGACACCAACTTCCTACCCTCTCAGCCTCAAAGTAACTC

>HSCOC4_0_0_9885
(SEQ ID NO:530)
GCTGAGGTGTGGCCGAGGACCTGACCATCTGGAAGTGTGAAAATCCCCTT

The following list of abbreviations for tissues was used in the TAA histograms. The term "TAA" stands for "Tumor Associated Antigen", and the TAA histograms, given in the text, represent the cancerous tissue expression pattern as predicted by the biomarkers selection engine, as described in detail in examples 1-5 below:

"BONE" for "bone";
"COL" for "colon";
"EPI" for "epithelial";
"GEN" for "general";
"LIVER" for "liver";
"LUN" for "lung";
"LYMPH" for "lymph nodes";
"MARROW" for "bone marrow";
"OVA" for "ovary";
"PANCREAS" for "pancreas";
"PRO" for "prostate";
"STOMACH" for "stomach";
"TCELL" for "T cells";
"THYROID" for "Thyroid";
"MAM" for "breast";
"BRAIN" for "brain";
"UTERUS" for "uterus";
"SKIN" for "skin";
"KIDNEY" for "kidney";
"MUSCLE" for "muscle";
"ADREN" for "adrenal";
"HEAD" for "head and neck";
"BLADDER" for "bladder";

It should be noted that the terms "segment", "seg" and "node" are used interchangeably in reference to nucleic acid sequences of the present invention; they refer to portions of nucleic acid sequences that were shown to have one or more properties as described below. They are also the building blocks that were used to construct complete nucleic acid sequences as described in greater detail below. Optionally and preferably, they are examples of oligonucleotides which are embodiments of the present invention, for example as amplicons, hybridization units and/or from which primers and/or complementary oligonucleotides may optionally be derived, and/or for any other use.

As used herein the phrase "prostate cancer" refers to cancers of the prostate tissue and/or other tissues of the male genitalia, or reproductive or urinary tracts.

The term "marker" in the context of the present invention refers to a nucleic acid fragment, a peptide, or a polypeptide, which is differentially present in a sample taken from subjects (patients) having prostate cancer as compared to a comparable sample taken from subjects who do not have prostate cancer.

The phrase "differentially present" refers to differences in the quantity of a marker present in a sample taken from patients having prostate cancer as compared to a comparable sample taken from patients who do not have prostate cancer. For example, a nucleic acid fragment may optionally be differentially present between the two samples if the amount of the nucleic acid fragment in one sample is significantly different from the amount of the nucleic acid fragment in the other sample, for example as measured by hybridization and/or NAT-based assays. A polypeptide is differentially present between the two samples if the amount of the polypeptide in one sample is significantly different from the amount of the polypeptide in the other sample. It should be noted that if the marker is detectable in one sample and not detectable in the other, then such a marker can be considered to be differentially present.

As used herein the phrase "diagnostic" means identifying the presence or nature of a pathologic condition. Diagnostic methods differ in their sensitivity and specificity. The "sensitivity" of a diagnostic assay is the percentage of diseased individuals who test positive (percent of "true positives"). Diseased individuals not detected by the assay are "false negatives." Subjects who are not diseased and who test negative in the assay are termed "true negatives." The "specificity" of a diagnostic assay is 1 minus the false positive rate, where the "false positive" rate is defined as the proportion of those without the disease who test positive. While a particular diagnostic method may not provide a definitive diagnosis of a condition, it suffices if the method provides a positive indication that aids in diagnosis.

As used herein the phrase "diagnosing" refers to classifying a disease or a symptom, determining a severity of the disease, monitoring disease progression, forecasting an outcome of a disease and/or prospects of recovery. The term "detecting" may also optionally encompass any of the above.

Diagnosis of a disease according to the present invention can be affected by determining a level of a polynucleotide or a polypeptide of the present invention in a biological sample obtained from the subject, wherein the level determined can be correlated with predisposition to, or presence or absence of the disease. It should be noted that a "biological sample obtained from the subject" may also optionally comprise a sample that has not been physically removed from the subject, as described in greater detail below.

As used herein, the term "level" refers to expression levels of RNA and/or protein or to DNA copy number of a marker of the present invention.

Typically the level of the marker in a biological sample obtained from the subject is different (i.e., increased or decreased) from the level of the same variant in a similar sample obtained from a healthy individual (examples of biological samples are described herein).

Numerous well known tissue or fluid collection methods can be utilized to collect the biological sample from the subject in order to determine the level of DNA, RNA and/or polypeptide of the variant of interest in the subject.

Examples include, but are not limited to, fine needle biopsy, needle biopsy, core needle biopsy and surgical biopsy (e.g., brain biopsy), and lavage. Regardless of the procedure employed, once a biopsy/sample is obtained the level of the variant can be determined and a diagnosis can thus be made.

Determining the level of the same variant in normal tissues of the same origin is preferably effected along-side to detect an elevated expression and/or amplification and/or a decreased expression, of the variant as opposed to the normal tissues.

A "test amount" of a marker refers to an amount of a marker in a subject's sample that is consistent with a diagnosis of prostate cancer. A test amount can be either in absolute amount (e.g., microgram/ml) or a relative amount (e.g., relative intensity of signals).

A "control amount" of a marker can be any amount or a range of amounts to be compared against a test amount of a marker. For example, a control amount of a marker can be the amount of a marker in a patient with prostate cancer or a person without prostate cancer. A control amount can be either in absolute amount (e.g., microgram/ml) or a relative amount (e.g., relative intensity of signals).

"Detect" refers to identifying the presence, absence or amount of the object to be detected.

A "label" includes any moiety or item detectable by spectroscopic, photo chemical, biochemical, immunochemical, or chemical means. For example, useful labels include $^{32}P$, $^{35}S$, fluorescent dyes, electron-dense reagents, enzymes (e.g., as commonly used in an ELISA), biotin-streptavadin, dioxigenin, haptens and proteins for which antisera or monoclonal antibodies are available, or nucleic acid molecules with a sequence complementary to a target. The label often generates a measurable signal, such as a radioactive, chromogenic, or fluorescent signal, that can be used to quantify the amount of bound label in a sample. The label can be incorporated in or attached to a primer or probe either covalently, or through ionic, van der Waals or hydrogen bonds, e.g., incorporation of radioactive nucleotides, or biotinylated nucleotides that are recognized by streptavadin. The label may be directly or indirectly detectable. Indirect detection can involve the binding of a second label to the first label, directly or indirectly. For example, the label can be the ligand of a binding partner, such as biotin, which is a binding partner for streptavadin, or a nucleotide sequence, which is the binding partner for a complementary sequence, to which it can specifically hybridize. The binding partner may itself be directly detectable, for example, an antibody may be itself labeled with a fluorescent molecule. The binding partner also may be indirectly detectable, for example, a nucleic acid having a complementary nucleotide sequence can be a part of a branched DNA molecule that is in turn detectable through hybridization with other labeled nucleic acid molecules (see, e.g., P. D. Fahrlander and A. Klausner, Bio/Technology 6:1165 (1988)). Quantitation of the signal is achieved by, e.g., scintillation counting, densitometry, or flow cytometry.

Exemplary detectable labels, optionally and preferably for use with immunoassays, include but are not limited to magnetic beads, fluorescent dyes, radiolabels, enzymes (e.g., horse radish peroxidase, alkaline phosphatase and others commonly used in an ELISA), and calorimetric labels such as colloidal gold or colored glass or plastic beads. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

"Immunoassay" is an assay that uses an antibody to specifically bind an antigen. The immunoassay is characterized by the use of specific binding properties of a particular antibody to isolate, target, and/or quantify the antigen.

The phrase "specifically (or selectively) binds" to an antibody or "specifically (or selectively) immunoreactive with," when referring to a protein or peptide (or other epitope), refers to a binding reaction that is determinative of the presence of the protein in a heterogeneous population of proteins and other biologics. Thus, under designated immunoassay conditions, the specified antibodies bind to a particular protein at least two times greater than the background (non-specific signal) and do not substantially bind in a significant amount to other proteins present in the sample. Specific binding to an antibody under such conditions may require an antibody that is selected for its specificity for a particular protein. For example, polyclonal antibodies raised to seminal basic protein from specific species such as rat, mouse, or human can be selected to obtain only those polyclonal antibodies that are specifically immunoreactive with seminal basic protein and not with other proteins, except for polymorphic variants and alleles of seminal basic protein. This selection may be achieved by subtracting out antibodies that cross-react with seminal basic protein molecules from other species. A variety of immunoassay formats may be used to select antibodies specifically immunoreactive with a particular protein. For example, solid-phase ELISA immunoassays are routinely used to select antibodies specifically immunoreactive with a protein (see, e.g., Harlow & Lane, Antibodies, A Laboratory Manual (1988), for a description of immunoassay formats and conditions that can be used to determine specific immunoreactivity). Typically a specific or selective reaction will be at least twice background signal or noise and more typically more than 10 to 100 times background.

According to preferred embodiments of the present invention, there is provided an isolated polynucleotide comprising a segment SEQ ID NOs: 1,2, 3 and 4.

According to preferred embodiments of the present invention, there is provided an isolated polynucleotide comprising a segment SEQ ID NOs: 60, 61, 62, 63, 64, 65, 66, 67, 68, 69, 70, 71, 72, 73, 74, 75, 76, 77, 78, 79, 80, 81, 82, 83, 84, 85, 86, 87, 88 and 89.

According to preferred embodiments of the present invention, there is provided an isolated polypeptide comprising SEQ ID NOs: 327, 328, 329, 330.

According to preferred embodiments of the present invention, there is provided an isolated polynucleotide comprising a segment SEQ ID NOs: SEQ ID NOs. 5, 6, 7, 8, 9 and 10.

According to preferred embodiments of the present invention, there is provided an isolated polynucleotide comprising a segment SEQ ID NOs: 90, 91, 92, 93, 94, 95, 96, 97, 98, 99, 100, 101, 102, 103, 104, 105, 106, 107, 108, 109, 110, 111, 112, 113, 114 and 115.

According to preferred embodiments of the present invention, there is provided an isolated polypeptide comprising SEQ ID NOs: 331, 332, 333, 334 and 335.

According to preferred embodiments of the present invention, there is provided an isolated polynucleotide comprising a segment SEQ ID NOs: 11.

According to preferred embodiments of the present invention, there is provided an isolated polynucleotide comprising a segment SEQ ID NOs: 116, 117, 118, 119, 120, 121, 122, 123, 124, 125, 126, 127, 128 and 129.

According to preferred embodiments of the present invention, there is provided an isolated polypeptide comprising SEQ ID NOs: 336.

According to preferred embodiments of the present invention, there is provided an isolated polynucleotide comprising a segment SEQ ID NOs: 12.

According to preferred embodiments of the present invention, there is provided an isolated polynucleotide comprising a segment SEQ ID NOs: 130, 131, 132, 133, 134 and 135.

According to preferred embodiments of the present invention, there is provided an isolated polypeptide comprising SEQ ID NOs: 337.

According to preferred embodiments of the present invention, there is provided an isolated polynucleotide comprising a segment SEQ ID NOs: 34, 35, 36, 37, 38 and 39.

According to preferred embodiments of the present invention, there is provided an isolated polynucleotide comprising a segment SEQ ID NOs: 222, 223, 224, 225, 226, 227, 228, 229, 230, 231, 232, 233, 234, 235, 236 and 237.

According to preferred embodiments of the present invention, there is provided an isolated polypeptide comprising SEQ ID NOs: 359, 360, 361, 362 and 363.

According to preferred embodiments of the present invention, there is provided an isolated polynucleotide comprising a segment SEQ ID NOs: 15, 16, 17, 18, 19, 20, 21, 22, 23, 24, 25, 26, 27, 28, 29, 30, 31, 32 and 33.

According to preferred embodiments of the present invention, there is provided an isolated polypeptide comprising SEQ ID NOs: 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220 and 221.

According to preferred embodiments of the present invention, there is provided an isolated polypeptide comprising SEQ ID NOs: 340, 341, 342, 343, 344, 345, 346, 347, 348, 349, 350, 351, 352, 353, 354, 355, 356, 357 and 358.

According to preferred embodiments of the present invention, there is provided an isolated polynucleotide comprising a segment SEQ ID NOs: 13 and 14.

According to preferred embodiments of the present invention, there is provided an isolated polypeptide comprising SEQ ID NOs: 136, 137, 138, 139, 140, 141 and 142.

According to preferred embodiments of the present invention, there is provided an isolated polypeptide comprising SEQ ID NOs: 338 and 339.

According to preferred embodiments of the present invention, there is provided an isolated polynucleotide comprising a segment SEQ ID NOs: 40, 41 and 42.

According to preferred embodiments of the present invention, there is provided an isolated polynucleotide comprising a segment SEQ ID NOs: 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269 and 270.

According to preferred embodiments of the present invention, there is provided an isolated polypeptide comprising SEQ ID NOs: 364, 365 and 366.

According to preferred embodiments of the present invention, there is provided an isolated polynucleotide comprising a segment SEQ ID NOs: 43.

According to preferred embodiments of the present invention, there is provided an isolated polynucleotide comprising a segment SEQ ID NOs: 271, 272, 273, 274, 275, 276, 277, 278, 279, 280, 281, 282, 283 and 284.

According to preferred embodiments of the present invention, there is provided an isolated polypeptide comprising SEQ ID NOs: 367.

According to preferred embodiments of the present invention, there is provided an isolated polynucleotide comprising a segment SEQ ID NOs: 44 and 45.

According to preferred embodiments of the present invention, there is provided an isolated polynucleotide comprising a segment SEQ ID NOs: 285, 286, 287, 288, 289, 290, 291, 292, 293, 294, 295, 296, 297, 298, 299, 300, 301, 302, 303 and 304.

According to preferred embodiments of the present invention, there is provided an isolated polypeptide comprising SEQ ID NOs: 368 and 369.

According to preferred embodiments of the present invention, there is provided an isolated polynucleotide comprising a segment SEQ ID NOs: 46, 47, 48, 49, 50, 51, 52, 53, 54, 55, 56, 57, 58 and 59.

According to preferred embodiments of the present invention, there is provided an isolated polynucleotide comprising a segment SEQ ID NOs: 305, 306, 307, 308, 309, 310, 311, 312, 313, 314, 315, 316, 317, 318, 319, 320, 321, 322, 323, 324, 325 and 326.

According to preferred embodiments of the present invention, there is provided an isolated polypeptide comprising SEQ ID NOs: 370, 371, 372, 373, 374, 375, 376, 377, 378, 379, 380, 381, 382 and 383.

According to preferred embodiments of the present invention, there is provided an isolated chimeric polypeptide encoding for SEQ ID NO. 383, comprising a first amino acid sequence being at least 90% homologous to corresponding to amino acids 1-45 of SEQ ID NO. 398, which also corresponds to amino acids 1-45 of SEQ ID NO. 383, and a second amino acid sequence being at least 70%, optionally at least 80%, preferably at least 85%, more preferably at least 90% and most preferably at least 95% homologous to a polypeptide having the sequence corresponding to amino acids 46-85 of SEQ ID NO. 383, wherein said first amino acid sequence and second amino acid sequence are contiguous and in a sequential order.

According to preferred embodiments of the present invention, there is provided an isolated polypeptide encoding for a tail of SEQ ID NO. 383, comprising a polypeptide being at least 70%, optionally at least about 80%, preferably at least about 85%, more preferably at least about 90% and most preferably at least about 95% homologous to amino acids 46-85 in SEQ ID NO. 383.

According to preferred embodiments of the present invention, there is provided an isolated chimeric polypeptide encoding for SEQ ID NOs. 359, comprising a first amino acid sequence being at least 90% homologous to corresponding to amino acids 1-163 of SEQ ID NOs. 391, which also corresponds to amino acids 1-163 of SEQ ID NOs. 359, a bridging amino acid H corresponding to amino acid 164 of SEQ ID NOs. 359, a second amino acid sequence being at least 90% homologous to corresponding to amino acids 165-445 of SEQ ID NOs. 391, which also corresponds to amino acids 165-445 of SEQ ID NO. 359, and a third amino acid sequence being at least 70%, optionally at least 80%, preferably at least 85%, more preferably at least 90% and most preferably at least 95% homologous to a polypeptide having the sequence corresponding to amino acids 446-496 of SEQ ID NO. 359, wherein said first amino acid sequence, bridging amino acid, second amino acid sequence and third amino acid sequence are contiguous and in a sequential order.

According to preferred embodiments of the present invention, there is provided an isolated polypeptide encoding for a tail of SEQ ID NO. 359, comprising a polypeptide being at least 70%, optionally at least about 80%, preferably at least about 85%, more preferably at least about 90% and most preferably at least about 95% homologous to amino acids 446-496 in SEQ ID NO. 359.

According to preferred embodiments of the present invention, there is provided an isolated chimeric polypeptide encoding for SEQ ID NOs. 360, comprising a first amino acid sequence being at least 90% homologous to corresponding to amino acids 1-163 of SEQ ID NOs. 391, which also corresponds to amino acids 1-163 of SEQ ID NO. 360, a bridging amino acid H corresponding to amino acid 164 of SEQ ID NO. 360, a second amino acid sequence being at least 90% homologous to corresponding to amino acids 165-358 of SEQ ID NOs. 391, which also corresponds to amino acids 165-358 of SEQ ID NO. 360, and a third amino acid sequence being at least 70%, optionally at least 80%, preferably at least 85%, more preferably at least 90% and most preferably at least 95% homologous to a polypeptide having the sequence corresponding to amino acids 359-382 of SEQ ID NO. 360, wherein said first amino acid sequence, bridging amino acid, second amino acid sequence and third amino acid sequence are contiguous and in a sequential order.

According to preferred embodiments of the present invention, there is provided an isolated polypeptide encoding for a tail of SEQ ID NO. 360, comprising a polypeptide being at least 70%, optionally at least about 80%, preferably at least about 85%, more preferably at least about 90% and most preferably at least about 95% homologous to amino acids 359-382 in SEQ ID NO. 360.

According to preferred embodiments of the present invention, there is provided an isolated chimeric polypeptide encoding for SEQ ID NO. 361, comprising a first amino acid sequence being at least 90% homologous to corresponding to amino acids 1-163 of SEQ ID NOs. 391, which also corresponds to amino acids 1-163 of SEQ ID NO. 361, a bridging amino acid H corresponding to amino acid 164 of SEQ ID NO. 361, a second amino acid sequence being at least 90% homologous to corresponding to amino acids 165-359 of SEQ ID NOs. 391, which also corresponds to amino acids 165-359 of SEQ ID NO. 361, and a third amino acid sequence being at least 70%, optionally at least 80%, preferably at least 85%, more preferably at least 90% and most preferably at least 95% homologous to a polypeptide having the sequence corresponding to amino acids 360-370 of SEQ ID NO. 361, wherein said first amino acid sequence, bridging amino acid, second amino acid sequence and third amino acid sequence are contiguous and in a sequential order.

According to preferred embodiments of the present invention, there is provided an isolated polypeptide encoding for a tail of SEQ ID NO. 361, comprising a polypeptide being at least 70%, optionally at least about 80%, preferably at least about 85%, more preferably at least about 90% and most preferably at least about 95% homologous to amino acids 360-370 in SEQ ID NO. 361.

According to preferred embodiments of the present invention, there is provided an isolated chimeric polypeptide encoding for SEQ ID NO. 362, comprising a first amino acid sequence being at least 90% homologous to corresponding to amino acids 1-163 of SEQ ID NOs. SEQ ID NOs. 391, which also corresponds to amino acids 1-163 of SEQ ID NO. 362, a bridging amino acid H corresponding to amino acid 164 of SEQ ID NO. 362, a second amino acid sequence being at least 90% homologous to corresponding to amino acids 165-286 of SEQ ID NOs. 391, which also corresponds to amino acids 165-286 of SEQ ID NO. 362, and a third amino acid sequence being at least 70%, optionally at least 80%, preferably at least 85%, more preferably at least 90% and most preferably at least 95% homologous to a polypeptide having the sequence corresponding to amino acids 287-301 of SEQ ID NO. 362, wherein said first amino acid sequence, bridging amino acid, second amino acid sequence and third amino acid sequence are contiguous and in a sequential order.

According to preferred embodiments of the present invention, there is provided an isolated polypeptide encoding for a tail of SEQ ID NO. 362, comprising a polypeptide being at least 70%, optionally at least about 80%, preferably at least about 85%, more preferably at least about 90% and most preferably at least about 95% homologous to amino acids 287-301 in SEQ ID NO. 362.

According to preferred embodiments of the present invention, there is provided an isolated chimeric polypeptide encoding for SEQ ID NO. 363, comprising a first amino acid sequence being at least 90% homologous to corresponding to amino acids 1-96 of SEQ ID NOs. 391, which also corresponds to amino acids 1-96 of SEQ ID NO. 363, a second amino acid sequence being at least 90% homologous to corresponding to amino acids 113-163 of SEQ ID NOs. 391, which also corresponds to amino acids 97-147 of SEQ ID NO. 363, a bridging amino acid H corresponding to amino acid 148 of SEQ ID NO. 363, a third amino acid sequence being at least 90% homologous to corresponding to amino acids 165-359 of SEQ ID NOs. 391, which also corresponds to amino acids 149-343 of SEQ ID NO. 363, and a fourth amino acid sequence being at least 70%, optionally at least 80%, preferably at least 85%, more preferably at least 90% and most preferably at least 95% homologous to a polypeptide sequence corresponding to amino acids 344-354 of SEQ ID NO. 363, wherein said first amino acid sequence, second amino acid sequence, bridging amino acid, third amino acid sequence and fourth amino acid sequence are contiguous and in a sequential order.

According to preferred embodiments of the present invention, there is provided an isolated chimeric polypeptide encoding for an edge portion of SEQ ID NO. 363, comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KR, having a structure as follows: a sequence starting from any of amino acid numbers 96-x to 96; and ending at any of amino acid numbers 97+((n−2)−x), in which x varies from 0 to n−2.

According to preferred embodiments of the present invention, there is provided an isolated polypeptide encoding for a tail of SEQ ID NO. 363, comprising a polypeptide being at least 70%, optionally at least about 80%, preferably at least about 85%, more preferably at least about 90% and most preferably at least about 95% homologous to the sequence in SEQ ID NO. 363.

According to preferred embodiments of the present invention, there is provided an isolated chimeric polypeptide encoding for SEQ ID NO. 340, comprising a first amino acid sequence being at least 90% homologous to corresponding to amino acids 1-865 of CO4_HUMAN, which also corresponds to amino acids 1-865 of SEQ ID NO. 340, and a second amino acid sequence being at least 70%, optionally at least 80%, preferably at least 85%, more preferably at least 90% and most preferably at least 95% homologous to a polypeptide sequence corresponding to amino acids 866-887 of SEQ ID NO. 340, wherein said first amino acid sequence and second amino acid sequence are contiguous and in a sequential order.

According to preferred embodiments of the present invention, there is provided an isolated polypeptide encoding for a tail of SEQ ID NO. 340, comprising a polypeptide being at least 70%, optionally at least about 80%, preferably at least about 85%, more preferably at least about 90% and most preferably at least about 95% homologous to amino acids 866-887 in SEQ ID NO. 340.

According to preferred embodiments of the present invention, there is provided an isolated chimeric polypeptide encoding for SEQ ID NO. 341, comprising a first amino acid sequence being at least 90% homologous to corresponding to amino acids 1-818 of CO4_HUMAN, which also corresponds to amino acids 1-818 of SEQ ID NO. 341, and a second amino acid sequence being at least 70%, optionally at least 80%, preferably at least 85%, more preferably at least 90% and most preferably at least 95% homologous to a polypeptide sequence corresponding to amino acids 819-843 of SEQ ID NO. 341, wherein said first amino acid sequence and second amino acid sequence are contiguous and in a sequential order.

According to preferred embodiments of the present invention, there is provided an isolated polypeptide encoding for a tail of SEQ ID NO. 341, comprising a polypeptide being at least 70%, optionally at least about 80%, preferably at least about 85%, more preferably at least about 90% and most preferably at least about 95% homologous to amino acids 819-843 in SEQ ID NO. 341.

According to preferred embodiments of the present invention, there is provided an isolated chimeric polypeptide encoding for SEQ SEQ ID NO. 342, comprising a first amino acid sequence being at least 90% homologous to corresponding to amino acids 1-1052 of CO4_HUMAN, which also corresponds to amino acids 1-1052 of SEQ ID NO. 342, and a second amino acid sequence being at least 70%, optionally at least 80%, preferably at least 85%, more preferably at least 90% and most preferably at least 95% homologous to a polypeptide sequence corresponding to amino acids 1053-1084 of SEQ ID NO. 342, wherein said first amino acid sequence and second amino acid sequence are contiguous and in a sequential order.

According to preferred embodiments of the present invention, there is provided an isolated polypeptide encoding for a tail of SEQ ID NO. 342, comprising a polypeptide being at least 70%, optionally at least about 80%, preferably at least about 85%, more preferably at least about 90% and most preferably at least about 95% homologous to the sequence in SEQ ID NO. 342.

According to preferred embodiments of the present invention, there is provided an isolated chimeric polypeptide encoding for SEQ ID NO. 343, comprising a first amino acid sequence being at least 90% homologous to corresponding to amino acids 1-1380 of SEQ ID NO. 389, which also corresponds to amino acids 1-1380 of SEQ ID NO. 343, and a second amino acid sequence being at least 70%, optionally at least 80%, preferably at least 85%, more preferably at least 90% and most preferably at least 95% homologous to a polypeptide sequence corresponding to amino acids 1381-1397 of SEQ ID NO. 343, wherein said first amino acid sequence and second amino acid sequence are contiguous and in a sequential order.

According to preferred embodiments of the present invention, there is provided an isolated polypeptide encoding for a tail of SEQ SEQ ID NO. 343, comprising a polypeptide being at least 70%, optionally at least about 80%, preferably at least about 85%, more preferably at least about 90% and most preferably at least about 95% homologous to the sequence in SEQ ID NO. 343.

According to preferred embodiments of the present invention, there is provided an isolated chimeric polypeptide encoding for SEQ ID NO. 344, comprising a first amino acid sequence being at least 90% homologous to corresponding to amino acids 1-1359 of SEQ ID NO. 389, which also corresponds to amino acids 1-1359 of SEQ ID NO. 344, and a second amino acid sequence being at least 70%, optionally at least 80%, preferably at least 85%, more preferably at least 90% and most preferably at least 95% homologous to a polypeptide sequence corresponding to amino acids 1360-1415 of SEQ ID NO. 344, wherein said first amino acid sequence and second amino acid sequence are contiguous and in a sequential order.

According to preferred embodiments of the present invention, there is provided an isolated polypeptide encoding for a tail of SEQ ID NO. 344, comprising a polypeptide being at least 70%, optionally at least about 80%, preferably at least about 85%, more preferably at least about 90% and most preferably at least about 95% homologous to amino acids 1360-1415 in SEQ ID NO. 344.

According to preferred embodiments of the present invention, there is provided an isolated chimeric polypeptide encoding for SEQ ID NO. 345, comprising a first amino acid sequence being at least 90% homologous to corresponding to amino acids 1-1457 of SEQ ID NO. 389, which also corresponds to amino acids 1-1457 of SEQ ID NO. 345, and a second amino acid sequence being at least 70%, optionally at least 80%, preferably at least 85%, more preferably at least 90% and most preferably at least 95% homologous to a polypeptide having the sequence corresponding to amino acids 1458-1483 of SEQ ID NO. 345, wherein said first amino acid sequence and second amino acid sequence are contiguous and in a sequential order.

According to preferred embodiments of the present invention, there is provided an isolated polypeptide encoding for a tail of SEQ ID NO. 345, comprising a polypeptide being at least 70%, optionally at least about 80%, preferably at least about 85%, more preferably at least about 90% and most preferably at least about 95% homologous to amino acids 1458-1483 in SEQ ID NO. 345.

According to preferred embodiments of the present invention, there is provided an isolated chimeric polypeptide encoding for SEQ ID NO. 346, comprising a first amino acid sequence being at least 90% homologous to corresponding to amino acids 1-1303 of SEQ ID NO. 389, which also corresponds to amino acids 1-1303 of SEQ ID NO. 346, and a second amino acid sequence being at least 70%, optionally at least 80%, preferably at least 85%, more preferably at least 90% and most preferably at least 95% homologous to a polypeptide sequence corresponding to amino acids 1304-1349 of SEQ ID NO. 346, wherein said first amino acid sequence and second amino acid sequence are contiguous and in a sequential order.

According to preferred embodiments of the present invention, there is provided an isolated polypeptide encoding for a tail of SEQ ID NO. 346, comprising a polypeptide being at least 70%, optionally at least about 80%, preferably at least about 85%, more preferably at least about 90% and most preferably at least about 95% homologous to the sequence in SEQ ID NO. 346.

According to preferred embodiments of the present invention, there is provided an isolated chimeric polypeptide encoding for SEQ ID NO. 347, comprising a first amino acid sequence being at least 90% homologous to corresponding to amino acids 1-1529 of SEQ ID NO. 389, which also corresponds to amino acids 1-1529 of SEQ ID NO. 347, and a second amino acid sequence being at least 70%, optionally at least 80%, preferably at least 85%, more preferably at least 90% and most preferably at least 95% homologous to a polypeptide sequence corresponding to amino acids 1530-1533 of SEQ ID NO. 347, wherein said first amino acid sequence and second amino acid sequence are contiguous and in a sequential order.

According to preferred embodiments of the present invention, there is provided an isolated polypeptide encoding for a tail of SEQ ID NO. 347, comprising a polypeptide being at least 70%, optionally at least about 80%, preferably at least about 85%, more preferably at least about 90% and most preferably at least about 95% homologous to amino acids 1530-1533 in SEQ ID NO. 347.

According to preferred embodiments of the present invention, there is provided an isolated chimeric polypeptide encoding for SEQ ID NO. 348, comprising a first amino acid sequence being at least 90% homologous to corresponding to amino acids 1-1653 of SEQ ID NO. 389, which also corresponds to amino acids 1-1653 of SEQ ID NO. 348, and a second amino acid sequence being at least 70%, optionally at least 80%, preferably at least 85%, more preferably at least 90% and most preferably at least 95% homologous to a polypeptide sequence corresponding to amino acids 1654-1670 of SEQ ID NO. 348, wherein said first amino acid sequence and second amino acid sequence are contiguous and in a sequential order.

According to preferred embodiments of the present invention, there is provided an isolated polypeptide encoding for a tail of SEQ ID NO. 348, comprising a polypeptide being at least 70%, optionally at least about 80%, preferably at least about 85%, more preferably at least about 90% and most preferably at least about 95% homologous to amino acids 1654-1670 in SEQ ID NO. 348.

According to preferred embodiments of the present invention, there is provided an isolated chimeric polypeptide encoding for SEQ ID NO. 349, comprising a first amino acid sequence being at least 90% homologous to corresponding to amino acids 1-1626 of SEQ ID NO. 389, which also corresponds to amino acids 1-1626 of SEQ ID NO. 349, and a second amino acid sequence being at least 70%, optionally at least 80%, preferably at least 85%, more preferably at least 90% and most preferably at least 95% homologous to a polypeptide sequence corresponding to amino acids 1627-1685 of SEQ ID NO. 349, wherein said first amino acid sequence and second amino acid sequence are contiguous and in a sequential order.

According to preferred embodiments of the present invention, there is provided an isolated polypeptide encoding for a tail of SEQ ID NO. 349, comprising a polypeptide being at least 70%, optionally at least about 80%, preferably at least about 85%, more preferably at least about 90% and most preferably at least about 95% homologous to amino acids 1627-1685 in SEQ ID NO. 349.

According to preferred embodiments of the present invention, there is provided an isolated chimeric polypeptide encoding for SEQ ID NO. 350, comprising a first amino acid sequence being at least 90% homologous to corresponding to amino acids 1-1528 of SEQ ID NO. 389, which also corresponds to amino acids 1-1528 of SEQ ID NO. 350, and a second amino acid sequence being at least 70%, optionally at least 80%, preferably at least 85%, more preferably at least 90% and most preferably at least 95% homologous to a polypeptide sequence corresponding to amino acids 1529-

1579 of SEQ ID NO. 350, wherein said first amino acid sequence and second amino acid sequence are contiguous and in a sequential order.

According to preferred embodiments of the present invention, there is provided an isolated polypeptide encoding for a tail of SEQ ID NO. 350, comprising a polypeptide being at least 70%, optionally at least about 80%, preferably at least about 85%, more preferably at least about 90% and most preferably at least about 95% homologous to amino acids 1529-1579 in SEQ ID NO. 350.

According to preferred embodiments of the present invention, there is provided an isolated chimeric polypeptide encoding for SEQ ID NO. 351, comprising a first amino acid sequence being at least 90% homologous to corresponding to amino acids 1-1593 of SEQ ID NO. 389, which also corresponds to amino acids 1-1593 of SEQ ID NO. 351, and a second amino acid sequence being at least 70%, optionally at least 80%, preferably at least 85%, more preferably at least 90% and most preferably at least 95% homologous to a polypeptide sequence corresponding to amino acids 1594-1657 of SEQ ID NO. 351, wherein said first amino acid sequence and second amino acid sequence are contiguous and in a sequential order.

According to preferred embodiments of the present invention, there is provided an isolated polypeptide encoding for a tail of SEQ ID NO. 351, comprising a polypeptide being at least 70%, optionally at least about 80%, preferably at least about 85%, more preferably at least about 90% and most preferably at least about 95% homologous to amino acids 1594-1657 in SEQ ID NO. 351.

According to preferred embodiments of the present invention, there is provided an isolated chimeric polypeptide encoding for SEQ ID NO. 352, comprising a first amino acid sequence being at least 90% homologous to corresponding to amino acids 1-1593 of SEQ ID NO. 389, which also corresponds to amino acids 1-1593 of SEQ ID NO. 352, and a second amino acid sequence being at least 70%, optionally at least 80%, preferably at least 85%, more preferably at least 90% and most preferably at least 95% homologous to a polypeptide sequence corresponding to amino acids 1594-1691 of SEQ ID NO. 352, wherein said first amino acid sequence and second amino acid sequence are contiguous and in a sequential order.

According to preferred embodiments of the present invention, there is provided an isolated polypeptide encoding for a tail of SEQ ID NO. 352, comprising a polypeptide being at least 70%, optionally at least about 80%, preferably at least about 85%, more preferably at least about 90% and most preferably at least about 95% homologous to amino acids 1594-1691 in SEQ ID NO. 352.

According to preferred embodiments of the present invention, there is provided an isolated chimeric polypeptide encoding for SEQ ID NO. 353, comprising a first amino acid sequence being at least 90% homologous to corresponding to amino acids 1-1232 of SEQ ID NO. 390, which also corresponds to amino acids 1-1232 of SEQ ID NO. 353, and a second amino acid sequence being at least 70%, optionally at least 80%, preferably at least 85%, more preferably at least 90% and most preferably at least 95% homologous to a polypeptide sequence corresponding to amino acids 1233-1253 of SEQ ID NO. 353, wherein said first amino acid sequence and second amino acid sequence are contiguous and in a sequential order.

According to preferred embodiments of the present invention, there is provided an isolated polypeptide encoding for a tail of SEQ ID NO. 353, comprising a polypeptide being at least 70%, optionally at least about 80%, preferably at least about 85%, more preferably at least about 90% and most preferably at least about 95% homologous to amino acids 1233-1253 in SEQ ID NO. 353.

According to preferred embodiments of the present invention, there is provided an isolated chimeric polypeptide encoding for SEQ ID NO. 354, comprising a first amino acid sequence being at least 90% homologous to corresponding to amino acids 1-818 of CO4_HUMAN, which also corresponds to amino acids 1-818 of SEQ ID NO. 354, and a second amino acid sequence being at least 70%, optionally at least 80%, preferably at least 85%, more preferably at least 90% and most preferably at least 95% homologous to a polypeptide sequence corresponding to amino acids 819-843 of SEQ ID NO. 354, wherein said first amino acid sequence and second amino acid sequence are contiguous and in a sequential order.

According to preferred embodiments of the present invention, there is provided an isolated polypeptide encoding for a tail of SEQ ID NO. 354, comprising a polypeptide being at least 70%, optionally at least about 80%, preferably at least about 85%, more preferably at least about 90% and most preferably at least about 95% homologous to to amino acids 819-843 in SEQ ID NO. 354.

According to preferred embodiments of the present invention, there is provided an isolated chimeric polypeptide encoding for SEQ ID NO. 355, comprising a first amino acid sequence being at least 90% homologous to corresponding to amino acids 1-387 of CO4_HUMAN, which also corresponds to amino acids 1-387 of SEQ ID NO. 355, and a second amino acid sequence being at least 70%, optionally at least 80%, preferably at least 85%, more preferably at least 90% and most preferably at least 95% homologous to a polypeptide having the sequence corresponding to amino acids 388-394 of SEQ SEQ ID NO. 355, wherein said first amino acid sequence and second amino acid sequence are contiguous and in a sequential order.

According to preferred embodiments of the present invention, there is provided an isolated polypeptide encoding for a tail of SEQ ID NO. 355, comprising a polypeptide being at least 70%, optionally at least about 80%, preferably at least about 85%, more preferably at least about 90% and most preferably at least about 95% homologous to amino acids 388-394 in SEQ ID NO. 355.

According to preferred embodiments of the present invention, there is provided an isolated chimeric polypeptide encoding for SEQ ID NO. 356, comprising a first amino acid sequence being at least 90% homologous to corresponding to amino acids 1-236 of CO4_HUMAN, which also corresponds to amino acids 1-236 of SEQ ID NO. 356, and a second amino acid sequence being at least 70%, optionally at least 80%, preferably at least 85%, more preferably at least 90% and most preferably at least 95% homologous to a polypeptide sequence corresponding to amino acids 237-263 of SEQ ID NO. 356, wherein said first amino acid sequence and second amino acid sequence are contiguous and in a sequential order.

According to preferred embodiments of the present invention, there is provided an isolated polypeptide encoding for a tail of SEQ ID NO. 356, comprising a polypeptide being at least 70%, optionally at least about 80%, preferably at least about 85%, more preferably at least about 90% and most preferably at least about 95% homologous to amino acids 237-263 in SEQ ID NO. 356.

According to preferred embodiments of the present invention, there is provided an isolated chimeric polypeptide encoding for SEQ ID NO. 357, comprising a first amino acid sequence being at least 90% homologous to corresponding to amino acids 1-1529 of SEQ ID NO. 389, which also corresponds to amino acids 1-1529 of SEQ ID NO. 357, and a second amino acid sequence being at least 70%, optionally at least 80%, preferably at least 85%, more preferably at least 90% and most preferably at least 95% homologous to a polypeptide sequence corresponding to amino acids 1530-1533 of SEQ ID NO. 357, wherein said first amino acid sequence and second amino acid sequence are contiguous and in a sequential order.

According to preferred embodiments of the present invention, there is provided an isolated polypeptide encoding for a tail of SEQ ID NO. 357, comprising a polypeptide being at least 70%, optionally at least about 80%, preferably at least about 85%, more preferably at least about 90% and most preferably at least about 95% homologous to the sequence SGER (SEQ ID NO: 551) in SEQ ID NO. 357.

According to preferred embodiments of the present invention, there is provided an isolated chimeric polypeptide encoding for SEQ ID NO. 358, comprising a first amino acid sequence being at least 90% homologous to corresponding to amino acids 1-1473 of SEQ ID NO. 389, which also corresponds to amino acids 1-1473 of SEQ ID NO. 358, a second amino acid sequence being at least 70%, optionally at least 80%, preferably at least 85%, more preferably at least 90% and most preferably at least 95% homologous to a polypeptide sequence corresponding to amino acids 1474-1511 of SEQ ID NO. 358, a third amino acid sequence being at least 90% homologous to corresponding to amino acids 1474-1503 of SEQ ID NO. 389, which also corresponds to amino acids 1512-1541 of SEQ ID NO. 358, and a fourth amino acid sequence being at least 70%, optionally at least 80%, preferably at least 85%, more preferably at least 90% and most preferably at least 95% homologous to a polypeptide having the sequence corresponding to amino acids 1542-1555 of SEQ ID NO. 358, wherein said first amino acid sequence, second amino acid sequence, third amino acid sequence and fourth amino acid sequence are contiguous and in a sequential order.

According to preferred embodiments of the present invention, there is provided an isolated polypeptide encoding for an edge portion of SEQ ID NO. 358, comprising an amino acid sequence being at least 70%, optionally at least about 80%, preferably at least about 85%, more preferably at least about 90% and most preferably at least about 95% homologous to amino acids 1474-1511, corresponding to SEQ ID NO. 358.

According to preferred embodiments of the present invention, there is provided an isolated polypeptide encoding for a tail of SEQ ID NO. 358, comprising a polypeptide being at least 70%, optionally at least about 80%, preferably at least about 85%, more preferably at least about 90% and most preferably at least about 95% homologous to amino acids 1542-1555 in SEQ ID NO. 358.

According to preferred embodiments of the present invention, there is provided an isolated chimeric polypeptide encoding for SEQ ID NO. 339, comprising a first amino acid sequence being at least 90% homologous to corresponding to amino acids 1-27 of SEQ ID NO. 387, which also corresponds to amino acids 1-27 of SEQ ID NO. 339, and a second amino acid sequence being at least 70%, optionally at least 80%, preferably at least 85%, more preferably at least 90% and most preferably at least 95% homologous to a polypeptide having the sequence corresponding to amino acids 28-41 of SEQ ID NO. 339, wherein said first amino acid sequence and second amino acid sequence are contiguous and in a sequential order.

According to preferred embodiments of the present invention, there is provided an isolated polypeptide encoding for a tail of SEQ ID NO. 339, comprising a polypeptide being at least 70%, optionally at least about 80%, preferably at least about 85%, more preferably at least about 90% and most preferably at least about 95% homologous to amino acids 28-41 in SEQ ID NO. 339.

According to preferred embodiments of the present invention, there is provided an isolated chimeric polypeptide encoding for SEQ ID NO. 364, comprising a first amino acid sequence being at least 90% homologous to corresponding to amino acids 1-1617 of SEQ ID NO. 393, which also corresponds to amino acids 1-1617 of SEQ ID NO. 364, and a second amino acid sequence being at least 70%, optionally at least 80%, preferably at least 85%, more preferably at least 90% and most preferably at least 95% homologous to a polypeptide having the sequence corresponding to amino acids 1618-1645 of SEQ ID NO. 364, wherein said first amino acid sequence and second amino acid sequence are contiguous and in a sequential order.

According to preferred embodiments of the present invention, there is provided an isolated polypeptide encoding for a tail of SEQ ID NO. 364, comprising a polypeptide being at least 70%, optionally at least about 80%, preferably at least about 85%, more preferably at least about 90% and most preferably at least about 95% homologous to amino acids 1618-1645 in SEQ ID NO. 364.

According to preferred embodiments of the present invention, there is provided an isolated chimeric polypeptide encoding for SEQ ID NO. 365, comprising a first amino acid sequence being at least 90% homologous to corresponding to amino acids 1-2062 of SEQ ID NO. 393, which also corresponds to amino acids 1-2062 of SEQ ID NO. 365, and a second amino acid sequence being at least 70%, optionally at least 80%, preferably at least 85%, more preferably at least 90% and most preferably at least 95% homologous to a polypeptide sequence corresponding to amino acids 2063-2074 of SEQ ID NO. 365, wherein said first amino acid sequence and second amino acid sequence are contiguous and in a sequential order.

According to preferred embodiments of the present invention, there is provided an isolated polypeptide encoding for a tail of SEQ ID NO. 365, comprising a polypeptide being at least 70%, optionally at least about 80%, preferably at least about 85%, more preferably at least about 90% and most preferably at least about 95% homologous to amino acids 2063-2074 in SEQ ID NO. 365.

According to preferred embodiments of the present invention, there is provided an isolated chimeric polypeptide encoding for SEQ ID NO. 366, comprising a first amino acid sequence being at least 90% homologous to corresponding to amino acids 1-587 of SEQ ID NO. 393, which also corresponds to amino acids 1-587 of SEQ ID NO. 366, and a second amino acid sequence being at least 70%, optionally at least 80%, preferably at least 85%, more preferably at least 90% and most preferably at least 95% homologous to a polypeptide sequence corresponding to amino acids 588-603 of SEQ ID NO. 366, wherein said first amino acid sequence and second amino acid sequence are contiguous and in a sequential order.

According to preferred embodiments of the present invention, there is provided an isolated polypeptide encoding for a tail of SEQ ID NO. 366, comprising a polypeptide being at least 70%, optionally at least about 80%, preferably at least about 85%, more preferably at least about 90% and most preferably at least about 95% homologous to amino acids 588-603 in SEQ ID NO. 366.

According to preferred embodiments of the present invention, there is provided an isolated chimeric polypeptide encoding for SEQ ID NO. 367, comprising a first amino acid sequence being at least 90% homologous to corresponding to amino acids 1-238 of SEQ ID NOs. 396, which also corresponds to amino acids 1-238 of SEQ ID NO. 367, and a second amino acid sequence being at least 70%, optionally at least 80%, preferably at least 85%, more preferably at least 90% and most preferably at least 95% homologous to a polypeptide sequence corresponding to amino acids 239-310 of SEQ ID NO. 367, wherein said first amino acid sequence and second amino acid sequence are contiguous and in a sequential order.

According to preferred embodiments of the present invention, there is provided an isolated polypeptide encoding for a tail of SEQ ID NO. 367, comprising a polypeptide being at least 70%, optionally at least about 80%, preferably at least about 85%, more preferably at least about 90% and most preferably at least about 95% homologous to amino acids 239-310 in SEQ ID NO. 367.

According to preferred embodiments of the present invention, there is provided an isolated chimeric polypeptide encoding for SEQ ID NO. 367, comprising a first amino acid sequence being at least 90% homologous to corresponding to amino acids 1-257 of SEQ ID NO. 395, which also corresponds to amino acids 1-257 of SEQ ID NO. 367, and a second amino acid sequence being at least 70%, optionally at least 80%, preferably at least 85%, more preferably at least 90% and most preferably at least 95% homologous to a polypeptide sequence corresponding to amino acids 258-310 of SEQ ID NO. 367, wherein said first amino acid sequence and second amino acid sequence are contiguous and in a sequential order.

According to preferred embodiments of the present invention, there is provided an isolated polypeptide encoding for a tail of SEQ ID NO. 367, comprising a polypeptide being at least 70%, optionally at least about 80%, preferably at least about 85%, more preferably at least about 90% and most preferably at least about 95% homologous to amino acids 258-310 in SEQ ID NO. 367.

According to preferred embodiments of the present invention, there is provided an isolated chimeric polypeptide encoding for SEQ ID NO. 367, comprising a first amino acid sequence being at least 90% homologous to corresponding to amino acids 1-257 of SEQ ID NO. 397, which also corresponds to amino acids 1-257 of SEQ ID NO. 367, and a second amino acid sequence being at least 70%, optionally at least 80%, preferably at least 85%, more preferably at least 90% and most preferably at least 95% homologous to a polypeptide having the sequence corresponding to amino acids 258-310 of SEQ ID NO. 367, wherein said first amino acid sequence and second amino acid sequence are contiguous and in a sequential order.

According to preferred embodiments of the present invention, there is provided an isolated polypeptide encoding for a tail of SEQ ID NO. 367, comprising a polypeptide being at least 70%, optionally at least about 80%, preferably at least about 85%, more preferably at least about 90% and most preferably at least about 95% homologous to amino acids 258-310 in SEQ ID NO. 367.

According to preferred embodiments of the present invention, there is provided an isolated chimeric polypeptide encoding for SEQ ID NO. 368, comprising a first amino acid sequence being at least 90% homologous to corresponding to amino acids 1-357 of Q8N441, which also corresponds to amino acids 1-357 of SEQ ID NO. 368, second amino acid sequence being at least 70%, optionally at least 80%, preferably at least 85%, more preferably at least 90% and most preferably at least 95% homologous to a polypeptide sequence corresponding to amino acids 358-437 of SEQ ID NO. 368, and a third amino acid sequence being at least 90% homologous to corresponding to amino acids 358-504 of Q8N441, which also corresponds to amino acids 438-584 of SEQ ID NO. 368, wherein said first, second and third amino acid sequences are contiguous and in a sequential order.

According to preferred embodiments of the present invention, there is provided an isolated polypeptide encoding for an edge portion of SEQ ID NO. 368, comprising an amino acid sequence being at least 70%, optionally at least about 80%, preferably at least about 85%, more preferably at least about 90% and most preferably at least about 95% homologous to amino acids 358-437, corresponding to SEQ ID NO. 368.

According to preferred embodiments of the present invention, there is provided an isolated chimeric polypeptide encoding for SEQ ID NO. 369, comprising a first amino acid sequence being at least 90% homologous to corresponding to amino acids 1-269 of Q9H4D7, which also corresponds to amino acids 1-269 of SEQ ID NO. 369, and a second amino acid sequence being at least 70%, optionally at least 80%, preferably at least 85%, more preferably at least 90% and most preferably at least 95% homologous to a polypeptide sequence corresponding to amino acids 270-490 of SEQ ID NO. 369, wherein said first and second amino acid sequences are contiguous and in a sequential order.

According to preferred embodiments of the present invention, there is provided an isolated polypeptide encoding for a tail of SEQ ID NO. 369, comprising a polypeptide being at least 70%, optionally at least about 80%, preferably at least about 85%, more preferably at least about 90% and most preferably at least about 95% homologous to amino acids 270-490 in SEQ ID NO. 369.

According to preferred embodiments of the present invention, there is provided an isolated chimeric polypeptide encoding for SEQ ID NO. 369, comprising a first amino acid sequence being at least 90% homologous to corresponding to amino acids 1-269 of Q8N441, which also corresponds to amino acids 1-269 of SEQ ID NO. 369, and a second amino acid sequence being at least 70%, optionally at least 80%, preferably at least 85%, more preferably at least 90% and most preferably at least 95% homologous to a polypeptide sequence corresponding to amino acids 270-490 of SEQ ID NO. 369, wherein said first and second amino acid sequences are contiguous and in a sequential order.

According to preferred embodiments of the present invention, there is provided an isolated polypeptide encoding for a tail of SEQ ID NO. 369, comprising a polypeptide being at least 70%, optionally at least about 80%, preferably at least about 85%, more preferably at least about 90% and most preferably at least about 95% homologous to amino acids 270-490 in SEQ ID NO. 369.

According to preferred embodiments of the present invention, there is provided an isolated chimeric polypeptide encoding for SEQ ID NO. 327, comprising a first amino acid sequence being at least 90% homologous to to amino acids 1-274 of SEQ ID NO. 384, which also corresponds to amino acids 1-274 of SEQ ID NO. 327, and a second amino acid sequence being at least 70%, optionally at least 80%, preferably at least 85%, more preferably at least 90% and most preferably at least 95% homologous to a polypeptide sequence corresponding to amino acids 275-322 of SEQ ID NO. 327, wherein said first and second amino acid sequences are contiguous and in a sequential order.

According to preferred embodiments of the present invention, there is provided an isolated polypeptide encoding for a tail of SEQ ID NO. 327, comprising a polypeptide being at least 70%, optionally at least about 80%, preferably at least about 85%, more preferably at least about 90% and most preferably at least about 95% homologous to amino acids 275-322 in SEQ ID NO. 327.

According to preferred embodiments of the present invention, there is provided an isolated chimeric polypeptide encoding for SEQ ID NO. 327, comprising a first amino acid sequence being at least 90% homologous to corresponding to amino acids 1-274 of Q9UII8, which also corresponds to amino acids 1-274 of SEQ ID NO. 327, and a second amino acid sequence being at least 70%, optionally at least 80%, preferably at least 85%, more preferably at least 90% and most preferably at least 95% homologous to a polypeptide sequence corresponding to amino acids 275-322 of SEQ ID NO. 327, wherein said first and second amino acid sequences are contiguous and in a sequential order.

According to preferred embodiments of the present invention, there is provided an isolated polypeptide encoding for a tail of SEQ SEQ ID NO. 327, comprising a polypeptide being at least 70%, optionally at least about 80%, preferably at least about 85%, more preferably at least about 90% and most preferably at least about 95% homologous to amino acids 275-322 in SEQ ID NO. 327.

According to preferred embodiments of the present invention, there is provided an isolated chimeric polypeptide encoding for SEQ ID NO. 327, comprising a first amino acid sequence being at least 90% homologous to amino acids 1-274 of CAD1_HUMAN, which also corresponds to amino acids 1-274 of SEQ ID NO. 327, and a second amino acid sequence being at least 70%, optionally at least 80%, preferably at least 85%, more preferably at least 90% and most preferably at least 95% homologous to a polypeptide sequence corresponding to amino acids 275-322 of SEQ ID NO. 327, wherein said first and second amino acid sequences are contiguous and in a sequential order.

According to preferred embodiments of the present invention, there is provided an isolated polypeptide encoding for a tail of SEQ ID NO. 327, comprising a polypeptide being at least 70%, optionally at least about 80%, preferably at least about 85%, more preferably at least about 90% and most preferably at least about 95% homologous to amino acids 275-322 in SEQ ID NO. 327.

According to preferred embodiments of the present invention, there is provided an isolated chimeric polypeptide encoding for SEQ ID NO. 328, comprising a first amino acid sequence being at least 90% homologous to corresponding to amino acids 1-379 of SEQ ID NO. 384, which also corresponds to amino acids 1-379 of SEQ ID NO. 328, and a second amino acid sequence VIL corresponding to amino acids 380-382 of SEQ ID NO. 328, wherein said first and second amino acid sequences are contiguous and in a sequential order.

According to preferred embodiments of the present invention, there is provided an isolated chimeric polypeptide encoding for SEQ ID NO. 328, comprising a first amino acid sequence being at least 90% homologous to corresponding to amino acids 1-379 of SEQ ID NO. 384, which also corresponds to amino acids 1-379 of SEQ ID NO. 328, and a second amino acid sequence VIL corresponding to amino acids 380-382 of SEQ ID NO. 328, wherein said first and second amino acid sequences are contiguous and in a sequential order.

According to preferred embodiments of the present invention, there is provided an isolated chimeric polypeptide encoding for SEQ ID NO. 328, comprising a first amino acid sequence being at least 90% homologous to corresponding to amino acids 1-379 of SEQ ID NO. 384, which also corresponds to amino acids 1-379 of SEQ ID NO. 328, and a second amino acid sequence corresponding to 380-382 of SEQ ID NO. 328, wherein said first and second amino acid sequences are contiguous and in a sequential order.

According to preferred embodiments of the present invention, there is provided an isolated chimeric polypeptide encoding for SEQ ID NO. 329, comprising a first amino acid sequence being at least 90% homologous to corresponding to amino acids 1-336 of SEQ ID NO. 384, which also corresponds to amino acids 1-336 of SEQ ID NO. 329, and a second amino acid sequence being at least 70%, optionally at least 80%, preferably at least 85%, more preferably at least 90% and most preferably at least 95% homologous to a polypeptide having the sequence corresponding to amino acids 337-373 of SEQ ID NO. 329, wherein said first and second amino acid sequences are contiguous and in a sequential order.

According to preferred embodiments of the present invention, there is provided an isolated polypeptide encoding for a tail of SEQ ID NO. 329, comprising a polypeptide being at least 70%, optionally at least about 80%, preferably at least about 85%, more preferably at least about 90% and most preferably at least about 95% homologous to amino acids 337-373 in SEQ ID NO. 329.

According to preferred embodiments of the present invention, there is provided an isolated chimeric polypeptide encoding for SEQ ID NO. 329, comprising a first amino acid sequence being at least 90% homologous to amino acids 1-336 of SEQ ID NO. 384, which also corresponds to amino acids 1-336 of SEQ ID NO. 329, and a second amino acid sequence being at least 70%, optionally at least 80%, preferably at least 85%, more preferably at least 90% and most preferably at least 95% homologous to a polypeptide sequence corresponding to amino acids 337-373 of SEQ ID NO. 329, wherein said first and second amino acid sequences are contiguous and in a sequential order.

According to preferred embodiments of the present invention, there is provided an isolated polypeptide encoding for a tail of SEQ ID NO. 329, comprising a polypeptide being at least 70%, optionally at least about 80%, preferably at least about 85%, more preferably at least about 90% and most preferably at least about 95% homologous to amino acids 337-373 in SEQ ID NO. 329.

According to preferred embodiments of the present invention, there is provided an isolated chimeric polypeptide encoding for SEQ ID NO. 329, comprising a first amino acid sequence being at least 90% homologous to corresponding to amino acids 1-336 of SEQ ID NO. 384, which also corresponds to amino acids 1-336 of SEQ ID NO. 329, and a second amino acid sequence being at least 70%, optionally at least 80%, preferably at least 85%, more preferably at least 90% and most preferably at least 95% homologous to a polypeptide having the sequence corresponding to amino acids 337-373 of SEQ ID NO. 329, wherein said first and second amino acid sequences are contiguous and in a sequential order.

According to preferred embodiments of the present invention, there is provided an isolated polypeptide encoding for a tail of SEQ ID NO. 329, comprising a polypeptide being at least 70%, optionally at least about 80%, preferably at least about 85%, more preferably at least about 90% and most preferably at least about 95% homologous to amino acids 337-373 in SEQ ID NO. 329.

According to preferred embodiments of the present invention, there is provided an isolated chimeric polypeptide encoding for SEQ ID NO. 330, comprising a first amino acid sequence being at least 90% homologous to corresponding to amino acids 1-229 of SEQ ID NO. 384, which also corresponds to amino acids 1-229 of SEQ ID NO. 330, and a second amino acid sequence VSIS corresponding to amino acids 230-233 of SEQ ID NO. 330 wherein said first and second amino acid sequences are contiguous and in a sequential order.

According to preferred embodiments of the present invention, there is provided an isolated chimeric polypeptide encoding for SEQ ID NO. 330, comprising a first amino acid sequence being at least 90% homologous to corresponding to amino acids 1-229 of SEQ ID NO. 384, which also corresponds to amino acids 1-229 of SEQ ID NO. 330, and a second amino acid sequence VSIS corresponding to amino acids 230-233 of SEQ ID NO. 330 wherein said first and second amino acid sequences are contiguous and in a sequential order.

According to preferred embodiments of the present invention, there is provided an isolated chimeric polypeptide encoding for SEQ ID NO. 330, comprising a first amino acid sequence being at least 90% homologous to corresponding to amino acids 1-229 of SEQ ID NO. 384, which also corresponds to amino acids 1-229 of SEQ ID NO. 330, and a second amino acid sequence VSIS corresponding to amino acids 230-233 of SEQ ID NO. 330 wherein said first and second amino acid sequences are contiguous and in a sequential order.

According to preferred embodiments of the present invention, there is provided an isolated chimeric polypeptide encoding for SEQ ID NO. 332, comprising a first amino acid sequence being at least 70%, optionally at least 80%, preferably at least 85%, more preferably at least 90% and most preferably at least 95% homologous to a polypeptide sequence corresponding to amino acids 1-110 of SEQ ID NO. 332, and a second amino acid sequence being at least 90% homologous to TQ corresponding to amino acids 1-112 of Q8IXM0, which also corresponds to amino acids 111-222 of SEQ ID NO. 332, wherein said first and second amino acid sequences are contiguous and in a sequential order.

According to preferred embodiments of the present invention, there is provided an isolated polypeptide encoding for a head of SEQ ID NO. 332, comprising a polypeptide being at least 70%, optionally at least about 80%, preferably at least about 85%, more preferably at least about 90% and most preferably at least about 95% homologous to amino acids 1-110 of SEQ ID NO. 332.

According to preferred embodiments of the present invention, there is provided an isolated chimeric polypeptide encoding for SEQ ID NO. 332, comprising a first amino acid sequence being at least 90% homologous to amino acids 1-83 of Q96AC2, which also corresponds to amino acids 1-83 of SEQ ID NO. 332, and a second amino acid sequence being at least 70%, optionally at least 80%, preferably at least 85%, more preferably at least 90% and most preferably at least 95% homologous to a polypeptide sequence corresponding to amino acids 84-222 of SEQ ID NO. 332, wherein said first and second amino acid sequences are contiguous and in a sequential order.

According to preferred embodiments of the present invention, there is provided an isolated polypeptide encoding for a tail of SEQ ID NO. 332, comprising a polypeptide being at least 70%, optionally at least about 80%, preferably at least about 85%, more preferably at least about 90% and most preferably at least about 95% homologous to amino acids 84-222 in SEQ ID NO. 332.

According to preferred embodiments of the present invention, there is provided an isolated chimeric polypeptide encoding for SEQ ID NO. 332, comprising a first amino acid sequence being at least 90% homologous to amino acids 1-83 of Q8N2G4, which also corresponds to amino acids 1-83 of SEQ ID NO. 332, and a second amino acid sequence being at least 70%, optionally at least 80%, preferably at least 85%, more preferably at least 90% and most preferably at least 95% homologous to a polypeptide sequence corresponding to amino acids 84-222 of SEQ ID NO. 332, wherein said first and second amino acid sequences are contiguous and in a sequential order.

According to preferred embodiments of the present invention, there is provided an isolated polypeptide encoding for a tail of SEQ ID NO. 332, comprising a polypeptide being at least 70%, optionally at least about 80%, preferably at least about 85%, more preferably at least about 90% and most preferably at least about 95% homologous to amino acids 84-222 in SEQ ID NO. 332.

According to preferred embodiments of the present invention, there is provided an isolated chimeric polypeptide encoding for SEQ ID NO. 332, comprising a first amino acid sequence being at least 90% homologous to amino acids 24-106 of BAC85518, which also corresponds to amino acids 1-83 of SEQ ID NO. 332, and a second amino acid sequence being at least 70%, optionally at least 80%, preferably at least 85%, more preferably at least 90% and most preferably at least 95% homologous to a polypeptide sequence corresponding to amino acids 84-222 of SEQ ID NO. 332, wherein said first and second amino acid sequences are contiguous and in a sequential order.

According to preferred embodiments of the present invention, there is provided an isolated polypeptide encoding for a tail of SEQ ID NO. 332, comprising a polypeptide being at least 70%, optionally at least about 80%, preferably at least about 85%, more preferably at least about 90% and most preferably at least about 95% homologous to amino acids 84-222 in SEQ ID NO. 332.

According to preferred embodiments of the present invention, there is provided an isolated chimeric polypeptide encoding for SEQ ID NO. 333, comprising a first amino acid sequence being at least 90% homologous to amino acids 1-64 of Q96AC2, which also corresponds to amino acids 1-64 of SEQ ID NO. 333, and a second amino acid sequence being at least 70%, optionally at least 80%, preferably at least 85%, more preferably at least 90% and most preferably at least 95% homologous to a polypeptide sequence corresponding to amino acids 65-93 of SEQ ID NO. 333, wherein said first and second amino acid sequences are contiguous and in a sequential order.

According to preferred embodiments of the present invention, there is provided an isolated polypeptide encoding for a tail of SEQ ID NO. 333, comprising a polypeptide being at least 70%, optionally at least about 80%, preferably at least about 85%, more preferably at least about 90% and most preferably at least about 95% homologous to amino acids 65-93 in SEQ ID NO. 333.

According to preferred embodiments of the present invention, there is provided an isolated chimeric polypeptide encoding for SEQ ID NO. 333, comprising a first amino acid sequence being at least 90% homologous to amino acids 1-64 of Q8N2G4, which also corresponds to amino acids 1-64 of SEQ ID NO. 333, and a second amino acid sequence being at least 70%, optionally at least 80%, preferably at least 85%, more preferably at least 90% and most preferably at least 95% homologous to a polypeptide sequence corresponding to amino acids 65-93 of SEQ ID NO. 333, wherein said first and second amino acid sequences are contiguous and in a sequential order.

According to preferred embodiments of the present invention, there is provided an isolated polypeptide encoding for a tail of SEQ ID NO. 333, comprising a polypeptide being at least 70%, optionally at least about 80%, preferably at least about 85%, more preferably at least about 90% and most preferably at least about 95% homologous to amino acids 65-93 in SEQ ID NO. 333.

According to preferred embodiments of the present invention, there is provided an isolated chimeric polypeptide encoding for SEQ ID NO. 333, comprising a first amino acid sequence being at least 70%, optionally at least 80%, preferably at least 85%, more preferably at least 90% and most preferably at least 95% homologous to a polypeptide sequence corresponding to amino acids 1-5 of SEQ ID NO. 333, second amino acid sequence being at least 90% homologous to amino acids 22-80 of BAC85273, which also corresponds to amino acids 6-64 of SEQ ID NO. 333, and a third amino acid sequence being at least 70%, optionally at least 80%, preferably at least 85%, more preferably at least 90% and most preferably at least 95% homologous to a polypeptide sequence corresponding to amino acids 65-93 of SEQ ID NO. 333, wherein said first, second and third amino acid sequences are contiguous and in a sequential order.

According to preferred embodiments of the present invention, there is provided an isolated polypeptide encoding for a head of SEQ ID NO. 333, comprising a polypeptide being at least 70%, optionally at least about 80%, preferably at least about 85%, more preferably at least about 90% and most preferably at least about 95% homologous to amino acids 1-5 of SEQ ID NO. 333.

According to preferred embodiments of the present invention, there is provided an isolated polypeptide encoding for a tail of SEQ ID NO. 333, comprising a polypeptide being at least 70%, optionally at least about 80%, preferably at least about 85%, more preferably at least about 90% and most preferably at least about 95% homologous to amino acids 65-93 in SEQ ID NO. 333.

According to preferred embodiments of the present invention, there is provided an isolated chimeric polypeptide encoding for SEQ ID NO. 333, comprising a first amino acid sequence being at least 90% homologous to amino acids 24-87 of BAC85518, which also corresponds to amino acids 1-64 of SEQ ID NO. 333, and a second amino acid sequence being at least 70%, optionally at least 80%, preferably at least 85%, more preferably at least 90% and most preferably at least 95% homologous to a polypeptide sequence corresponding to amino acids 65-93 of SEQ ID NO. 333, wherein said first and second amino acid sequences are contiguous and in a sequential order.

According to preferred embodiments of the present invention, there is provided an isolated polypeptide encoding for a tail of SEQ ID NO. 333, comprising a polypeptide being at least 70%, optionally at least about 80%, preferably at least about 85%, more preferably at least about 90% and most preferably at least about 95% homologous to amino acids 65-93 in SEQ ID NO. 333.

According to preferred embodiments of the present invention, there is provided an isolated chimeric polypeptide encoding for SEQ ID NO. 334, comprising a first amino acid sequence being at least 90% homologous to amino acids 1-63 of Q96AC2, which also corresponds to amino acids 1-63 of SEQ ID NO. 334, and a second amino acid sequence being at least 70%, optionally at least 80%, preferably at least 85%, more preferably at least 90% and most preferably at least 95% homologous to a polypeptide sequence corresponding to amino acids 64-84 of SEQ ID NO. 334, wherein said first and second amino acid sequences are contiguous and in a sequential order.

According to preferred embodiments of the present invention, there is provided an isolated polypeptide encoding for a tail of SEQ ID NO. 334, comprising a polypeptide being at least 70%, optionally at least about 80%, preferably at least about 85%, more preferably at least about 90% and most preferably at least about 95% homologous to amino acids 64-84 in SEQ ID NO. 334.

According to preferred embodiments of the present invention, there is provided an isolated chimeric polypeptide encoding for SEQ ID NO. 335, comprising a first amino acid sequence being at least 90% homologous to amino acids 1-63 of SEQ ID NOs. Q96AC2, which also corresponds to amino acids 1-63 of SEQ ID NO. 335, and a second amino acid sequence being at least 70%, optionally at least 80%, preferably at least 85%, more preferably at least 90% and most preferably at least 95% homologous to a polypeptide sequence corresponding to amino acids 64-90 of SEQ ID NO. 335, wherein said first and second amino acid sequences are contiguous and in a sequential order.

According to preferred embodiments of the present invention, there is provided an isolated polypeptide encoding for a tail of SEQ ID NO. 335, comprising a polypeptide being at least 70%, optionally at least about 80%, preferably at least about 85%, more preferably at least about 90% and most preferably at least about 95% homologous to amino acids 64-90 in SEQ ID NO. 335.

According to preferred embodiments of the present invention, there is provided an isolated chimeric polypeptide encoding for SEQ ID NO. 335, comprising a first amino acid sequence being at least 90% homologous to amino acids 1-63 of Q8N2G4, which also corresponds to amino acids 1-63 of SEQ ID NO. 335, and a second amino acid sequence being at least 70%, optionally at least 80%, preferably at least 85%, more preferably at least 90% and most preferably at least 95% homologous to a polypeptide sequence corresponding to amino acids 64-90 of SEQ ID NO. 335, wherein said first and second amino acid sequences are contiguous and in a sequential order.

According to preferred embodiments of the present invention, there is provided an isolated polypeptide encoding for a tail of SEQ ID NO. 335, comprising a polypeptide being at least 70%, optionally at least about 80%, preferably at least about 85%, more preferably at least about 90% and most preferably at least about 95% homologous to amino acids 64-90 in SEQ ID NO. 335.

According to preferred embodiments of the present invention, there is provided an isolated chimeric polypeptide encoding for SEQ ID NO. 335, comprising a first amino acid sequence being at least 70%, optionally at least 80%, preferably at least 85%, more preferably at least 90% and most preferably at least 95% homologous to a polypeptide sequence corresponding to amino acids 1-5 of SEQ ID NO. 335, second amino acid sequence being at least 90% homologous to amino acids 22-79 of BAC85273, which also corresponds to amino acids 6-63 of SEQ ID NO. 335, and a third amino acid sequence being at least 70%, optionally at least 80%, preferably at least 85%, more preferably at least 90% and most preferably at least 95% homologous to a polypeptide sequence corresponding to amino acids 64-90 of SEQ ID NO. 335, wherein said first, second and third amino acid sequences are contiguous and in a sequential order.

According to preferred embodiments of the present invention, there is provided an isolated polypeptide encoding for a head of SEQ ID NO. 335, comprising a polypeptide being at least 70%, optionally at least about 80%, preferably at least about 85%, more preferably at least about 90% and most preferably at least about 95% homologous to amino acids 1-5 of SEQ ID NO. 335.

According to preferred embodiments of the present invention, there is provided an isolated polypeptide encoding for a tail of SEQ ID NO. 335, comprising a polypeptide being at least 70%, optionally at least about 80%, preferably at least about 85%, more preferably at least about 90% and most preferably at least about 95% homologous to the amino acids 64-90 in SEQ ID NO. 335.

According to preferred embodiments of the present invention, there is provided an isolated chimeric polypeptide encoding for SEQ ID NO. 335, comprising a first amino acid sequence being at least 90% homologous to amino acids 24-86 of BAC85518, which also corresponds to amino acids 1-63 of SEQ ID NO. 335, and a second amino acid sequence being at least 70%, optionally at least 80%, preferably at least 85%, more preferably at least 90% and most preferably at least 95% homologous to a polypeptide sequence corresponding to amino acids 64-90 of SEQ ID NO. 335, wherein said first and second amino acid sequences are contiguous and in a sequential order.

According to preferred embodiments of the present invention, there is provided an isolated polypeptide encoding for a tail of SEQ ID NO. 335, comprising a polypeptide being at least 70%, optionally at least about 80%, preferably at least about 85%, more preferably at least about 90% and most preferably at least about 95% homologous to amino acids 64-90 in SEQ ID NO. 335.

According to preferred embodiments of the present invention, there is provided an isolated chimeric polypeptide encoding for SEQ ID NO. 336, comprising a first amino acid sequence being at least 90% homologous to amino acids 1-247 of SEQ ID NO. 385, which also corresponds to amino acids 1-247 of SEQ ID NO. 336, and a second amino acid sequence being at least 70%, optionally at least 80%, preferably at least 85%, more preferably at least 90% and most preferably at least 95% homologous to a polypeptide sequence corresponding to amino acids 248-255 of SEQ ID NO. 336, wherein said first and second amino acid sequences are contiguous and in a sequential order.

According to preferred embodiments of the present invention, there is provided an isolated polypeptide encoding for a tail of SEQ ID NO. 336, comprising a polypeptide being at least 70%, optionally at least about 80%, preferably at least about 85%, more preferably at least about 90% and most preferably at least about 95% homologous to amino acids 248-255 in SEQ ID NO. 336.

According to preferred embodiments of the present invention, there is provided an isolated chimeric polypeptide encoding for SEQ ID NO. 337, comprising a first amino acid sequence being at least 90% homologous to amino acids 1-66 of SEQ ID NO. 386, which also corresponds to amino acids 1-66 of SEQ ID NO. 337, and a second amino acid sequence being at least 70%, optionally at least 80%, preferably at least 85%, more preferably at least 90% and most preferably at least 95% homologous to a polypeptide sequence corresponding to amino acids 67-80 of SEQ ID NO. 337, wherein said first and second amino acid sequences are contiguous and in a sequential order.

According to preferred embodiments of the present invention, there is provided an isolated polypeptide encoding for a tail of SEQ ID NO. 337, comprising a polypeptide being at least 70%, optionally at least about 80%, preferably at least about 85%, more preferably at least about 90% and most preferably at least about 95% homologous to amino acids 67-80 in SEQ ID NO. 337.

According to preferred embodiments of the present invention, there is provided an antibody from cluster HSECADH, R11723, S78694, HUMTREFAC, HSCOC4, HSSTROL3, HUMF5A, Z40511, H53626 and HSMUC1A, capable of specifically binding to an epitope of an amino acid sequence.

Optionally the amino acid sequence corresponds to a bridge, edge portion, tail, head or insertion.

Optionally the antibody is capable of differentiating between a splice variant having said epitope and a corresponding known protein.

According to preferred embodiments of the present invention, there is provided a kit for detecting prostate cancer, comprising a kit from cluster HSECADH, R11723, S78694, HUMTREFAC, HSCOC4, HSSTROL3, HUMF5A, Z40511, H53626 and HSMUC1A for detecting overexpression of a splice variant.

Optionally the kit comprises a NAT-based technology.

Optionally the kit further comprises at least one primer pair capable of selectively hybridizing to a nucleic acid sequence.

Optionally the kit further comprises at least one oligonucleotide capable of selectively hybridizing to a nucleic acid sequence.

Optionally the kit comprises an antibody.

Optionally the kit further comprises at least one reagent for performing an ELISA or a Western blot.

According to preferred embodiments of the present invention, there is provided a method for detecting prostate cancer, comprising detecting overexpression of a splice variant from cluster HSECADH, R11723, S78694, HUMTREFAC, HSCOC4, HSSTROL3, HUMF5A, Z40511, H53626 and HSMUC1A.

Optionally detecting overexpression is performed with a NAT-based technology.

Optionally detecting overexpression is performed with an immunoassay.

Optionally the immunoassay comprises an antibody.

According to preferred embodiments of the present invention, there is provided a biomarker capable of detecting prostate cancer, comprising nucleic acid sequences or a fragment thereof, or amino acid sequences or a fragment thereof from cluster HSECADH, R11723, S78694, HUMTREFAC, HSCOC4, HSSTROL3, HUMF5A, Z40511, H53626 and HSMUC1A.

According to preferred embodiments of the present invention, there is provided a method for screening for prostate cancer, comprising detecting prostate cancer cells with a biomarker or an antibody or a method or assay from cluster HSECADH, R11723, S78694, HUMTREFAC, HSCOC4, HSSTROL3, HUMF5A, Z40511, H53626 and HSMUC1A.

According to preferred embodiments of the present invention, there is provided a method for diagnosing prostate cancer, comprising detecting prostate cancer cells with a biomarker or an antibody or a method or assay from cluster HSECADH, R11723, S78694, HUMTREFAC, HSCOC4, HSSTROL3, HUMF5A, Z40511, H53626 and HSMUC1A.

According to preferred embodiments of the present invention, there is provided a method for monitoring disease progression, treatment efficacy, relapse of prostate cancer, comprising detecting prostate cancer cells with a biomarker or an antibody or a method or assay from cluster HSECADH, R11723, S78694, HUMTREFAC, HSCOC4, HSSTROL3, HUMF5A, Z40511, H53626 and HSMUC1A.

According to preferred embodiments of the present invention, there is provided a method of selecting a therapy for prostate cancer, comprising detecting prostate cancer cells with a biomarker or an antibody or a method or assay from cluster HSECADH, R11723, S78694, HUMTREFAC, HSCOC4, HSSTROL3, HUMF5A, Z40511, H53626 and HSMUC1A.

According to preferred embodiments of the present invention, preferably any of the above nucleic acid and/or amino acid sequences further comprises any sequence having at least about 70%, preferably at least about 80%, more preferably at least about 90%, most preferably at least about 95% homology thereto.

All nucleic acid sequences and/or amino acid sequences shown herein as embodiments of the present invention relate to their isolated form, as isolated polynucleotides (including for all transcripts), oligonucleotides (including for all segments, amplicons and primers), peptides (including for all tails, bridges, insertions or heads, optionally including other antibody epitopes as described herein) and/or polypeptides (including for all proteins). It should be noted that oligonucleotide and polynucleotide, or peptide and polypeptide, may optionally be used interchangeably.

Unless otherwise noted, all experimental data relates to variants of the present invention, named according to the segment being tested (as expression was tested through RT-PCR as described).

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). All of these are hereby incorporated by reference as if fully set forth herein. As used herein, the following terms have the meanings ascribed to them unless specified otherwise.

BRIEF DESCRIPTION OF DRAWINGS

The patent or application file contains at least one drawing executed in color. Copies of this patent or patent application publication with color drawing(s) will be provided by the U.S. Patent and Trademark Office upon request and payment of the necessary fee.

FIG. 16 is a histogram showing Cancer and cell-line vs. normal tissue expression for Cluster H53626, demonstrating overexpression in epithelial malignant tumors, a mixture of malignant tumors from different tissues and myosarcoma.

FIG. 17 is a histogram showing Cancer and cell-line vs. normal tissue expression for Cluster HSMUC1A, demonstrating overexpression in a mixture of malignant tumors from different tissues, breast malignant tumors, pancreas carcinoma and prostate cancer.

FIG. 18B is a duplicate experiment.

DESCRIPTION OF PREFERRED EMBODIMENTS

Figure 1:
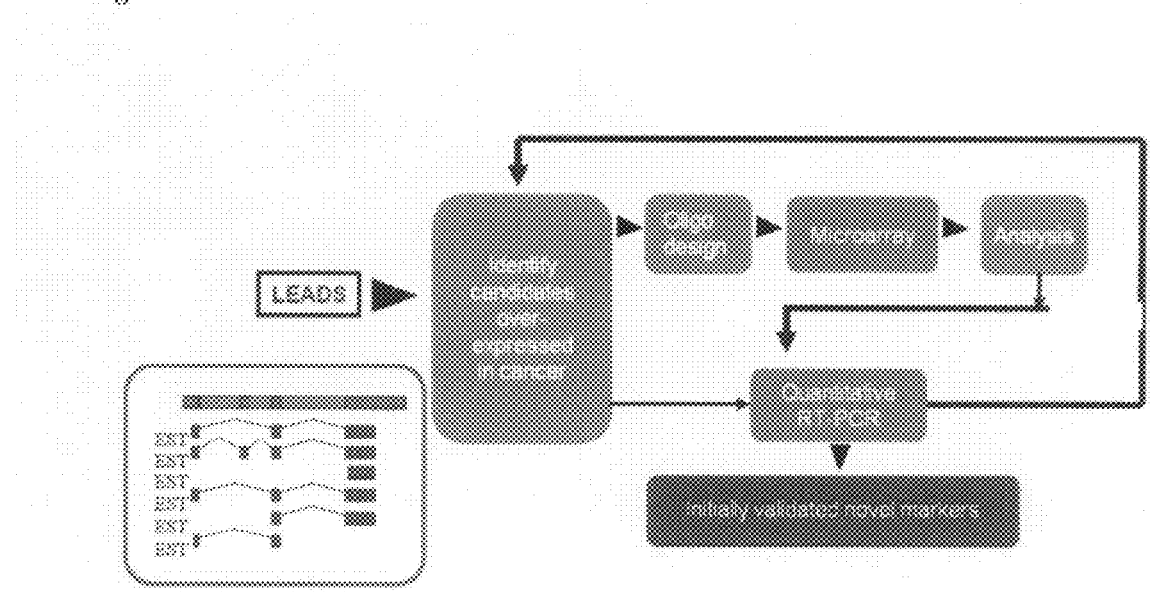
FIG. 1 is a schematic description of the cancer biomarker selection engine.

The present invention is of novel markers for prostate cancer that are both sensitive and accurate. Biomolecular sequences (amino acid and/or nucleic acid sequences) uncovered using the methodology of the present invention and described herein can be efficiently utilized as tissue or pathological markers and/or as drugs or drug targets for treating or preventing a disease.

These markers are specifically released to the bloodstream under conditions of prostate cancer and/or other prostate pathology, and/or are otherwise expressed at a much higher level and/or specifically expressed in prostate cancer tissue or cells. The measurement of these markers, alone or in combination, in patient samples provides information that the diagnostician can correlate with a probable diagnosis of prostate cancer and/or pathology.

The present invention therefore also relates to diagnostic assays for prostate cancer and/or prostate pathology, and methods of use of such markers for detection of prostate cancer and/or prostate pathology, optionally and preferably in a sample taken from a subject (patient), which is more preferably some type of blood sample.

The markers of the present invention, alone or in combination, can be used for prognosis, prediction, screening, early diagnosis, staging, therapy selection and treatment monitoring of prostate cancer. For example, optionally and preferably, these markers may be used for staging prostate cancer and/or monitoring the progression of the disease. Furthermore, the markers of the present invention, alone or in combination, can be used for detection of the source of metastasis found in anatomical places other then prostate. Also, one or more of the markers may optionally be used in combination with one or more other prostate cancer markers (other than those described herein).

Biomolecular sequences (amino acid and/or nucleic acid sequences) uncovered using the methodology of the present invention and described herein can be efficiently utilized as tissue or pathological markers and/or as drugs or drug targets for treating or preventing a disease.

These markers are specifically released to the bloodstream under conditions of prostate cancer (or one of the above indicative conditions), and/or are otherwise expressed at a much higher level and/or specifically expressed in prostate cancer tissue or cells, and/or tissue or cells under one of the above indicative conditions. The measurement of these markers, alone or in combination, in patient samples provides information that the diagnostician can correlate with a probable diagnosis of prostate cancer and/or a condition that it is indicative of a higher risk for prostate cancer.

The present invention therefore also relates to diagnostic assays for prostate cancer and/or an indicative condition, and methods of use of such markers for detection of prostate cancer and/or an indicative condition, optionally and preferably in a sample taken from a subject (patient), which is more preferably some type of blood sample.

According to a preferred embodiment of the present invention, use of the marker optionally and preferably permits a non-cancerous prostate disease state to be distinguished from prostate cancer and/or an indicative condition. A non limiting example of a non-cancerous prostate disease state includes BPH. According to another preferred embodiment of the present invention, use of the marker optionally and preferably permits an indicative condition to be distinguished from prostate cancer.

In another embodiment, the present invention relates to bridges, tails, heads and/or insertions, and/or analogs, homologs and derivatives of such peptides. Such bridges, tails, heads and/or insertions are described in greater detail below with regard to the Examples.

As used herein a "tail" refers to a peptide sequence at the end of an amino acid sequence that is unique to a splice variant according to the present invention. Therefore, a splice variant having such a tail may optionally be considered as a chimera, in that at least a first portion of the splice variant is typically highly homologous (often 100% identical) to a portion of the corresponding known protein, while at least a second portion of the variant comprises the tail.

As used herein a "head" refers to a peptide sequence at the beginning of an amino acid sequence that is unique to a splice variant according to the present invention. Therefore, a splice variant having such a head may optionally be considered as a chimera, in that at least a first portion of the splice variant comprises the head, while at least a second portion is typically highly homologous (often 100% identical) to a portion of the corresponding known protein.

As used herein "an edge portion" refers to a connection between two portions of a splice variant according to the present invention that were not joined in the wild type or known protein. An edge may optionally arise due to a join between the above "known protein" portion of a variant and the tail, for example, and/or may occur if an internal portion of the wild type sequence is no longer present, such that two portions of the sequence are now contiguous in the splice variant that were not contiguous in the known protein. A "bridge" may optionally be an edge portion as described above, but may also include a join between a head and a "known protein" portion of a variant, or a join between a tail and a "known protein" portion of a variant, or a join between an insertion and a "known protein" portion of a variant.

Optionally and preferably, a bridge between a tail or a head or a unique insertion, and a "known protein" portion of a variant, comprises at least about 10 amino acids, more preferably at least about 20 amino acids, most preferably at least about 30 amino acids, and even more preferably at least about 40 amino acids, in which at least one amino acid is from the tail/head/insertion and at least one amino acid is from the "known protein" portion of a variant. Also optionally, the bridge may comprise any number of amino acids from about 10 to about 40 amino acids (for example, 10, 11, 12, 13 . . . 37, 38, 39, 40 amino acids in length, or any number in between).

It should be noted that a bridge cannot be extended beyond the length of the sequence in either direction, and it should be assumed that every bridge description is to be read in such manner that the bridge length does not extend beyond the sequence itself.

Furthermore, bridges are described with regard to a sliding window in certain contexts below. For example, certain descriptions of the bridges feature the following format: a bridge between two edges (in which a portion of the known protein is not present in the variant) may optionally be described as follows: a bridge portion of CONTIG-NAME_P1 (representing the name of the protein), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise XX (2 amino acids in the center of the bridge, one from each end of the edge), having a structure as follows (numbering according to the sequence of CONTIG-NAME_P1): a sequence starting from any of amino acid numbers 49−x to 49 (for example); and ending at any of amino acid numbers 50+((n−2)−x) (for example), in which x varies from 0 to n−2. In this example, it should also be read as including bridges in which n is any number of amino acids between 10-50 amino acids in length. Furthermore, the bridge polypeptide cannot extend beyond the sequence, so it should be read such that 49−x (for example) is not less than 1, nor 50+((n−2)−x) (for example) greater than the total sequence length.

In another embodiment, this invention provides antibodies specifically recognizing the splice variants and polypeptide fragments thereof of this invention. Preferably such antibodies differentially recognize splice variants of the present invention but do not recognize a corresponding known protein (such known proteins are discussed with regard to their splice variants in the Examples below).

In another embodiment, this invention provides an isolated nucleic acid molecule encoding for a splice variant according to the present invention, having a nucleotide sequence as set forth in any one of the sequences listed herein, or a sequence complementary thereto. In another embodiment, this invention provides an isolated nucleic acid molecule, having a nucleotide sequence as set forth in any one of the sequences listed herein, or a sequence complementary thereto. In another embodiment, this invention provides an oligonucleotide of at least about 12 nucleotides, specifically hybridizable with the nucleic acid molecules of this invention. In another embodiment, this invention provides vectors, cells, liposomes and compositions comprising the isolated nucleic acids of this invention.

In another embodiment, this invention provides a method for detecting a splice variant according to the present invention in a biological sample, comprising: contacting a biological sample with an antibody specifically recognizing a splice variant according to the present invention under conditions whereby the antibody specifically interacts with the splice variant in the biological sample but do not recognize known corresponding proteins (wherein the known protein is discussed with regard to its splice variant(s) in the Examples below), and detecting said interaction; wherein the presence of an interaction correlates with the presence of a splice variant in the biological sample.

In another embodiment, this invention provides a method for detecting a splice variant nucleic acid sequences in a biological sample, comprising: hybridizing the isolated nucleic acid molecules or oligonucleotide fragments of at least about a minimum length to a nucleic acid material of a biological sample and detecting a hybridization complex; wherein the presence of a hybridization complex correlates with the presence of a splice variant nucleic acid sequence in the biological sample.

According to the present invention, the splice variants described herein are non-limiting examples of markers for diagnosing prostate cancer and/or prostate pathology. Each splice variant marker of the present invention can be used alone or in combination, for various uses, including but not limited to, prognosis, prediction, screening, early diagnosis, determination of progression, therapy selection and treatment monitoring of prostate cancer and/or prostate pathology.

According to optional but preferred embodiments of the present invention, any marker according to the present invention may optionally be used alone or combination. Such a combination may optionally comprise a plurality of markers described herein, optionally including any subcombination of markers, and/or a combination featuring at least one other marker, for example a known marker. Furthermore, such a combination may optionally and preferably be used as described above with regard to determining a ratio between a quantitative or semi-quantitative measurement of any marker described herein to any other marker described herein, and/or any other known marker, and/or any other marker. With regard to such a ratio between any marker described herein (or a combination thereof) and a known marker, more preferably the known marker comprises the "known protein" as described in greater detail below with regard to each cluster or gene.

According to other preferred embodiments of the present invention, a splice variant protein or a fragment thereof, or a splice variant nucleic acid sequence or a fragment thereof, may be featured as a biomarker for detecting prostate cancer and/or prostate pathology, such that a biomarker may optionally comprise any of the above.

According to still other preferred embodiments, the present invention optionally and preferably encompasses any amino acid sequence or fragment thereof encoded by a nucleic acid sequence corresponding to a splice variant protein as described herein. Any oligopeptide or peptide relating to such an amino acid sequence or fragment thereof may optionally also (additionally or alternatively) be used as a biomarker, including but not limited to the unique amino acid sequences of these proteins that are depicted as tails, heads, insertions, edges or bridges. The present invention also optionally encompasses antibodies capable of recognizing, and/or being elicited by, such oligopeptides or peptides.

The present invention also optionally and preferably encompasses any nucleic acid sequence or fragment thereof, or amino acid sequence or fragment thereof, corresponding to a splice variant of the present invention as described above, optionally for any application.

Non-limiting examples of methods or assays are described below.

The present invention also relates to kits based upon such diagnostic methods or assays.

Nucleic Acid Sequences and Oligonucleotides

Various embodiments of the present invention encompass nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or artificially induced, either randomly or in a targeted fashion.

The present invention encompasses nucleic acid sequences described herein; fragments thereof, sequences hybridizable therewith, sequences homologous thereto [e.g., at least 50%, at least 55%, at least 60%, at least 65%, at least 70%, at least 75%, at least 80%, at least 85%, at least 95% or more say 100% identical to the nucleic acid sequences set forth below], sequences encoding similar polypeptides with different codon usage, altered sequences characterized by mutations, such as deletion, insertion or substitution of one or more nucleotides, either naturally occurring or man induced, either randomly or in a targeted fashion. The present invention also encompasses homologous nucleic acid sequences (i.e., which form a part of a polynucleotide sequence of the present invention) which include sequence regions unique to the polynucleotides of the present invention.

In cases where the polynucleotide sequences of the present invention encode previously unidentified polypeptides, the present invention also encompasses novel polypeptides or portions thereof, which are encoded by the isolated polynucleotide and respective nucleic acid fragments thereof described hereinabove.

A "nucleic acid fragment" or an "oligonucleotide" or a "polynucleotide" are used herein interchangeably to refer to a polymer of nucleic acids. A polynucleotide sequence of the present invention refers to a single or double stranded nucleic acid sequences which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is composed of genomic and cDNA sequences. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Preferred embodiments of the present invention encompass oligonucleotide probes.

An example of an oligonucleotide probe which can be utilized by the present invention is a single stranded polynucleotide which includes a sequence complementary to the unique sequence region of any variant according to the present invention, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Alternatively, an oligonucleotide probe of the present invention can be designed to hybridize with a nucleic acid sequence encompassed by any of the above nucleic acid sequences, particularly the portions specified above, including but not limited to a nucleotide sequence coding for an amino sequence of a bridge, tail, head and/or insertion according to the present invention, and/or the equivalent portions of any nucleotide sequence given herein (including but not limited to a nucleotide sequence of a node, segment or amplicon described herein).

Oligonucleotides designed according to the teachings of the present invention can be generated according to any oligonucleotide synthesis method known in the art such as enzymatic synthesis or solid phase synthesis. Equipment and reagents for executing solid-phase synthesis are commercially available from, for example, Applied Biosystems. Any other means for such synthesis may also be employed; the actual synthesis of the oligonucleotides is well within the capabilities of one skilled in the art and can be accomplished via established methodologies as detailed in, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988) and "Oligonucleotide Synthesis" Gait, M. J., ed. (1984) utilizing solid phase chemistry, e.g. cyanoethyl phosphoramidite followed by deprotection, desalting and purification by for example, an automated trityl-on method or HPLC.

Oligonucleotides used according to this aspect of the present invention are those having a length selected from a range of about 10 to about 200 bases preferably about 15 to about 150 bases, more preferably about 20 to about 100 bases, most preferably about 20 to about 50 bases. Preferably, the oligonucleotide of the present invention features at least 17, at least 18, at least 19, at least 20, at least 22, at least 25, at least 30 or at least 40, bases specifically hybridizable with the biomarkers of the present invention.

The oligonucleotides of the present invention may comprise heterocylic nucleosides consisting of purines and the pyrimidines bases, bonded in a 3' to 5' phosphodiester linkage.

Preferably used oligonucleotides are those modified at one or more of the backbone, internucleoside linkages or bases, as is broadly described hereinunder.

Specific examples of preferred oligonucleotides useful according to this aspect of the present invention include oligonucleotides containing modified backbones or non-natural internucleoside linkages. Oligonucleotides having modified backbones include those that retain a phosphorus atom in the backbone, as disclosed in U.S. Pat. Nos. 4,469, 863; 4,476,301; 5,023,243; 5,177,196; 5,188,897; 5,264, 423; 5,276,019; 5,278,302; 5,286,717; 5,321,131; 5,399, 676; 5,405,939; 5,453,496; 5,455,233; 5,466, 677; 5,476, 925; 5,519,126; 5,536,821; 5,541,306; 5,550,111; 5,563, 253; 5,571,799; 5,587,361; and 5,625,050.

Preferred modified oligonucleotide backbones include, for example, phosphorothioates, chiral phosphorothioates, phosphorodithioates, phosphotriesters, aminoalkyl phosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms can also be used.

Alternatively, modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts, as disclosed in U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439.

Other oligonucleotides which can be used according to the present invention, are those modified in both sugar and the internucleoside linkage, i.e., the backbone, of the nucleotide units are replaced with novel groups. The base units are maintained for complementation with the appropriate polynucleotide target. An example for such an oligonucleotide mimetic, includes peptide nucleic acid (PNA). United States patents that teach the preparation of PNA compounds include, but are not limited to, U.S. Pat. Nos. 5,539,082; 5,714,331; and 5,719,262, each of which is herein incorporated by reference. Other backbone modifications, which can be used in the present invention are disclosed in U.S. Pat. No. 6,303,374.

Oligonucleotides of the present invention may also include base modifications or substitutions. As used herein, "unmodified" or "natural" bases include the purine bases adenine (A) and guanine (G), and the pyrimidine bases thymine (T), cytosine (C) and uracil (U). Modified bases include but are not limited to other synthetic and natural bases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further bases particularly useful for increasing the binding affinity of the oligomeric compounds of the invention include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. and are presently preferred base substitutions, even more particularly when combined with 2'-O-methoxyethyl sugar modifications.

Another modification of the oligonucleotides of the invention involves chemically linking to the oligonucleotide one or more moieties or conjugates, which enhance the activity, cellular distribution or cellular uptake of the oligonucleotide. Such moieties include but are not limited to lipid moieties such as a cholesterol moiety, cholic acid, a thioether, e.g., hexyl-S-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxycholesterol moiety, as disclosed in U.S. Pat. No. 6,303,374.

It is not necessary for all positions in a given oligonucleotide molecule to be uniformly modified, and in fact more than one of the aforementioned modifications may be incorporated in a single compound or even at a single nucleoside within an oligonucleotide.

It will be appreciated that oligonucleotides of the present invention may include further modifications for more efficient use as diagnostic agents and/or to increase bioavailability, therapeutic efficacy and reduce cytotoxicity.

To enable cellular expression of the polynucleotides of the present invention, a nucleic acid construct according to the present invention may be used, which includes at least a coding region of one of the above nucleic acid sequences, and further includes at least one cis acting regulatory element. As used herein, the phrase "cis acting regulatory element" refers to a polynucleotide sequence, preferably a promoter, which binds a trans acting regulator and regulates the transcription of a coding sequence located downstream thereto.

Any suitable promoter sequence can be used by the nucleic acid construct of the present invention.

Preferably, the promoter utilized by the nucleic acid construct of the present invention is active in the specific cell population transformed. Examples of cell type-specific and/or tissue-specific promoters include promoters such as albumin that is liver specific, lymphoid specific promoters [Calame et al., (1988) Adv. Immunol. 43:235-275]; in particular promoters of T-cell receptors [Winoto et al., (1989) EMBO J. 8:729-733] and immunoglobulins; [Banerji et al. (1983) Cell 33729-740], neuron-specific promoters such as the neurofilament promoter [Byrne et al. (1989) Proc. Natl. Acad. Sci. USA 86:5473-5477], pancreas-specific promoters [Edlunch et al. (1985) Science 230:912-916] or mammary gland-specific promoters such as the milk whey promoter (U.S. Pat. No. 4,873,316 and European Application Publication No. 264,166). The nucleic acid construct of the present invention can further include an enhancer, which can be adjacent or distant to the promoter sequence and can function in up regulating the transcription therefrom.

The nucleic acid construct of the present invention preferably further includes an appropriate selectable marker and/or an origin of replication. Preferably, the nucleic acid construct utilized is a shuttle vector, which can propagate both in E. coli (wherein the construct comprises an appropriate selectable marker and origin of replication) and be compatible for propagation in cells, or integration in a gene and a tissue of choice. The construct according to the present invention can be, for example, a plasmid, a bacmid, a phagemid, a cosmid, a phage, a virus or an artificial chromosome.

Examples of suitable constructs include, but are not limited to, pcDNA3, pcDNA3.1 (+/−), pGL3, PzeoSV2 (+/−), pDisplay, pEF/myc/cyto, pCMV/myc/cyto each of which is commercially available from Invitrogen Co. (invitrogen dot com). Examples of retroviral vector and packaging systems are those sold by Clontech, San Diego, Calif., including Retro-X vectors pLNCX and pLXSN, which permit cloning into multiple cloning sites and the transgene is transcribed from CMV promoter. Vectors derived from Mo-MuLV are also included such as pBabe, where the transgene will be transcribed from the 5'LTR promoter.

Currently preferred in vivo nucleic acid transfer techniques include transfection with viral or non-viral constructs, such as adenovirus, lentivirus, Herpes simplex I virus, or adeno-associated virus (AAV) and lipid-based systems. Useful lipids for lipid-mediated transfer of the gene are, for example, DOTMA, DOPE, and DC-Chol [Tonkinson et al., Cancer Investigation, 14(1): 54-65 (1996)]. The most preferred constructs for use in gene therapy are viruses, most preferably adenoviruses, AAV, lentiviruses, or retroviruses. A viral construct such as a retroviral construct includes at least one transcriptional promoter/enhancer or locus-defining element(s), or other elements that control gene expression by other means such as alternate splicing, nuclear RNA export, or post-translational modification of messenger. Such vector constructs also include a packaging signal, long terminal repeats (LTRs) or portions thereof, and positive and negative strand primer binding sites appropriate to the virus used, unless it is already present in the viral construct. In addition, such a construct typically includes a signal sequence for secretion of the peptide from a host cell in which it is placed. Preferably the signal sequence for this purpose is a mammalian signal sequence or the signal sequence of the polypeptide variants of the present invention. Optionally, the construct may also include a signal that directs polyadenylation, as well as one or more restriction sites and a translation termination sequence. By way of example, such constructs will typically include a 5' LTR, a tRNA binding site, a packaging signal, an origin of second-strand DNA synthesis, and a 3' LTR or a portion thereof. Other vectors can be used that are non-viral, such as cationic lipids, polylysine, and dendrimers.

Hybridization Assays

Detection of a nucleic acid of interest in a biological sample may optionally be effected by hybridization-based assays using an oligonucleotide probe (non-limiting examples of probes according to the present invention were previously described).

Traditional hybridization assays include PCR, RT-PCR, Real-time PCR, RNase protection, in-situ hybridization, primer extension, Southern blots (DNA detection), dot or slot blots (DNA, RNA), and Northern blots (RNA detection) (NAT type assays are described in greater detail below). More recently, PNAs have been described (Nielsen et al. 1999, Current Opin. Biotechnol. 10:71-75). Other detection methods include kits containing probes on a dipstick setup and the like.

Hybridization based assays which allow the detection of a variant of interest (i.e., DNA or RNA) in a biological sample rely on the use of oligonucleotides which can be 10, 15, 20, or 30 to 100 nucleotides long preferably from 10 to 50, more preferably from 40 to 50 nucleotides long.

Thus, the isolated polynucleotides (oligonucleotides) of the present invention are preferably hybridizable with any of the herein described nucleic acid sequences under moderate to stringent hybridization conditions.

Moderate to stringent hybridization conditions are characterized by a hybridization solution such as containing 10% dextrane sulfate, 1. M NaCl, 1% SDS and $5 \times 10^6$ cpm $^{32}$P labeled probe, at 65° C., with a final wash solution of 0.2×SSC and 0.1% SDS and final wash at 65° C. and whereas moderate hybridization is effected using a hybridization solution containing 10% dextrane sulfate, 1 M NaCl, 1% SDS and $5 \times 10^6$ cpm $^{32}$P labeled probe, at 65° C., with a final wash solution of 1×SSC and 0.1% SDS and final wash at 50° C.

More generally, hybridization of short nucleic acids (below 200 bp in length, e.g. 17-40 bp in length) can be effected using the following exemplary hybridization protocols which can be modified according to the desired stringency; (i) hybridization solution of 6×SSC and 1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 1-1.5° C. below the $T_m$, final wash solution of 3 M TMACl, 0.01 M sodium phosphate (pH 6.8), 1 mM EDTA (pH 7.6), 0.5% SDS at 1-1.5° C. below the $T_m$; (ii) hybridization solution of 6×SSC and 0.1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 2-2.5° C. below the $T_m$, final wash solution of 3 M TMACl, 0.01 M sodium phosphate (pH 6.8), 1 mM EDTA (pH 7.6), 0.5% SDS at 1-1.5° C. below the $T_m$, final wash solution of 6×SSC, and final wash at 22° C.; (iii) hybridization solution of 6×SSC and 1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature.

The detection of hybrid duplexes can be carried out by a number of methods. Typically, hybridization duplexes are separated from unhybridized nucleic acids and the labels bound to the duplexes are then detected. Such labels refer to radioactive, fluorescent, biological or enzymatic tags or labels of standard use in the art. A label can be conjugated to either the oligonucleotide probes or the nucleic acids derived from the biological sample.

Probes can be labeled according to numerous well known methods. Non-limiting examples of radioactive labels include 3H, 14C, 32P, and 35S. Non-limiting examples of detectable markers include ligands, fluorophores, chemiluminescent agents, enzymes, and antibodies. Other detectable markers for use with probes, which can enable an increase in sensitivity of the method of the invention, include biotin and radio-nucleotides. It will become evident to the person of ordinary skill that the choice of a particular label dictates the manner in which it is bound to the probe.

For example, oligonucleotides of the present invention can be labeled subsequent to synthesis, by incorporating biotinylated dNTPs or rNTP, or some similar means (e.g., photo-cross-linking a psoralen derivative of biotin to RNAs), followed by addition of labeled streptavidin (e.g., phycoerythrin-conjugated streptavidin) or the equivalent. Alternatively, when fluorescently-labeled oligonucleotide probes are used, fluorescein, lissamine, phycoerythrin, rhodamine (Perkin Elmer Cetus), Cy2, Cy3, Cy3.5, Cy5, Cy5.5, Cy7, Fluor X (Amersham) and others [e.g., Kricka et al. (1992), Academic Press San Diego, Calif.] can be attached to the oligonucleotides.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays. For instance, samples may be hybridized to an irrelevant probe and treated with RNAse A prior to hybridization, to assess false hybridization.

Although the present invention is not specifically dependent on the use of a label for the detection of a particular nucleic acid sequence, such a label might be beneficial, by increasing the sensitivity of the detection. Furthermore, it enables automation. Probes can be labeled according to numerous well known methods.

As commonly known, radioactive nucleotides can be incorporated into probes of the invention by several methods. Non-limiting examples of radioactive labels include $^3$H, $^{14}$C, $^{32}$P, and $^{35}$S.

Those skilled in the art will appreciate that wash steps may be employed to wash away excess target DNA or probe as well as unbound conjugate. Further, standard heterogeneous assay formats are suitable for detecting the hybrids using the labels present on the oligonucleotide primers and probes.

It will be appreciated that a variety of controls may be usefully employed to improve accuracy of hybridization assays.

Probes of the invention can be utilized with naturally occurring sugar-phosphate backbones as well as modified backbones including phosphorothioates, dithionates, alkyl phosphonates and a-nucleotides and the like. Probes of the invention can be constructed of either ribonucleic acid (RNA) or deoxyribonucleic acid (DNA), and preferably of DNA.

NAT Assays

Detection of a nucleic acid of interest in a biological sample may also optionally be effected by NAT-based assays, which involve nucleic acid amplification technology, such as PCR for example (or variations thereof such as real-time PCR for example).

As used herein, a "primer" defines an oligonucleotide which is capable of annealing to (hybridizing with) a target sequence, thereby creating a double stranded region which can serve as an initiation point for DNA synthesis under suitable conditions.

Amplification of a selected, or target, nucleic acid sequence may be carried out by a number of suitable methods. See generally Kwoh et al., 1990, Am. Biotechnol. Lab. 8:14 Numerous amplification techniques have been described and can be readily adapted to suit particular needs of a person of ordinary skill. Non-limiting examples of amplification techniques include polymerase chain reaction (PCR), ligase chain reaction (LCR), strand displacement amplification (SDA), transcription-based amplification, the q3 replicase system and NASBA (Kwoh et al., 1989, Proc. Natl. Acad. Sci. USA 86, 1173-1177; Lizardi et al., 1988, BioTechnology 6:1197-1202; Malek et al., 1994, Methods Mol. Biol., 28:253-260; and Sambrook et al., 1989, supra).

The terminology "amplification pair" (or "primer pair") refers herein to a pair of oligonucleotides (oligos) of the present invention, which are selected to be used together in amplifying a selected nucleic acid sequence by one of a number of types of amplification processes, preferably a polymerase chain reaction. Other types of amplification processes include ligase chain reaction, strand displacement amplification, or nucleic acid sequence-based amplification, as explained in greater detail below. As commonly known in the art, the oligos are designed to bind to a complementary sequence under selected conditions.

In one particular embodiment, amplification of a nucleic acid sample from a patient is amplified under conditions which favor the amplification of the most abundant differentially expressed nucleic acid. In one preferred embodiment, RT-PCR is carried out on an mRNA sample from a patient under conditions which favor the amplification of the most abundant mRNA. In another preferred embodiment, the amplification of the differentially expressed nucleic acids is carried out simultaneously. It will be realized by a person skilled in the art that such methods could be adapted for the detection of differentially expressed proteins instead of differentially expressed nucleic acid sequences.

The nucleic acid (i.e. DNA or RNA) for practicing the present invention may be obtained according to well known methods.

Oligonucleotide primers of the present invention may be of any suitable length, depending on the particular assay format and the particular needs and targeted genomes employed. Optionally, the oligonucleotide primers are at least 12 nucleotides in length, preferably between 15 and 24 molecules, and they may be adapted to be especially suited to a chosen nucleic acid amplification system. As commonly known in the art, the oligonucleotide primers can be designed by taking into consideration the melting point of hybridization thereof with its targeted sequence (Sambrook et al., 1989, Molecular Cloning—A Laboratory Manual, 2nd Edition, CSH Laboratories; Ausubel et al., 1989, in Current Protocols in Molecular Biology, John Wiley & Sons Inc., N.Y.).

It will be appreciated that antisense oligonucleotides may be employed to quantify expression of a splice isoform of interest. Such detection is effected at the pre-mRNA level. Essentially the ability to quantitate transcription from a splice site of interest can be effected based on splice site accessibility. Oligonucleotides may compete with splicing factors for the splice site sequences. Thus, low activity of the antisense oligonucleotide is indicative of splicing activity.

The polymerase chain reaction and other nucleic acid amplification reactions are well known in the art (various non-limiting examples of these reactions are described in greater detail below). The pair of oligonucleotides according to this aspect of the present invention are preferably selected to have compatible melting temperatures (Tm), e.g., melting temperatures which differ by less than that 7° C., preferably less than 5° C., more preferably less than 4° C., most preferably less than 3° C., ideally between 3° C. and 0° C.

Polymerase Chain Reaction (PCR): The polymerase chain reaction (PCR), as described in U.S. Pat. Nos. 4,683,195 and 4,683,202 to Mullis and Mullis et al., is a method of increasing the concentration of a segment of target sequence in a mixture of genomic DNA without cloning or purification. This technology provides one approach to the problems of low target sequence concentration. PCR can be used to directly increase the concentration of the target to an easily detectable level. This process for amplifying the target sequence involves the introduction of a molar excess of two oligonucleotide primers which are complementary to their respective strands of the double-stranded target sequence to the DNA mixture containing the desired target sequence. The mixture is denatured and then allowed to hybridize. Following hybridization, the primers are extended with polymerase so as to form complementary strands. The steps of denaturation, hybridization (annealing), and polymerase extension (elongation) can be repeated as often as needed, in order to obtain relatively high concentrations of a segment of the desired target sequence.

The length of the segment of the desired target sequence is determined by the relative positions of the primers with respect to each other, and, therefore, this length is a controllable parameter. Because the desired segments of the target sequence become the dominant sequences (in terms of concentration) in the mixture, they are said to be "PCR-amplified."

Ligase Chain Reaction (LCR or LAR): The ligase chain reaction [LCR; sometimes referred to as "Ligase Amplification Reaction" (LAR)] has developed into a well-recognized alternative method of amplifying nucleic acids. In LCR, four oligonucleotides, two adjacent oligonucleotides which uniquely hybridize to one strand of target DNA, and a complementary set of adjacent oligonucleotides, which hybridize to the opposite strand are mixed and DNA ligase is added to the mixture. Provided that there is complete complementarity at the junction, ligase will covalently link each set of hybridized molecules. Importantly, in LCR, two probes are ligated together only when they base-pair with sequences in the target sample, without gaps or mismatches. Repeated cycles of denaturation, and ligation amplify a short segment of DNA. LCR has also been used in combination with PCR to achieve enhanced detection of single-base changes: see for example Segev, PCT Publication No. WO9001069 A1 (1990). However, because the four oligonucleotides used in this assay can pair to form two short ligatable fragments, there is the potential for the generation of target-independent background signal. The use of LCR for mutant screening is limited to the examination of specific nucleic acid positions.

Self-Sustained Synthetic Reaction (3SR/NASBA): The self-sustained sequence replication reaction (3SR) is a transcription-based in vitro amplification system that can exponentially amplify RNA sequences at a uniform temperature. The amplified RNA can then be utilized for mutation detection. In this method, an oligonucleotide primer is used to add a phage RNA polymerase promoter to the 5' end of the sequence of interest. In a cocktail of enzymes and substrates that includes a second primer, reverse transcriptase, RNase H, RNA polymerase and ribo-and deoxyribonucleoside triphosphates, the target sequence undergoes repeated rounds of transcription, cDNA synthesis and second-strand synthesis to amplify the area of interest. The use of 3SR to detect mutations is kinetically limited to screening small segments of DNA (e.g., 200-300 base pairs).

Q-Beta (Qβ) Replicase: In this method, a probe which recognizes the sequence of interest is attached to the replicatable RNA template for Qβ replicase. A previously identified major problem with false positives resulting from the replication of unhybridized probes has been addressed through use of a sequence-specific ligation step. However, available thermostable DNA ligases are not effective on this RNA substrate, so the ligation must be performed by T4 DNA ligase at low temperatures (37 degrees C.). This prevents the use of high temperature as a means of achieving specificity as in the LCR, the ligation event can be used to detect a mutation at the junction site, but not elsewhere.

A successful diagnostic method must be very specific. A straight-forward method of controlling the specificity of nucleic acid hybridization is by controlling the temperature of the reaction. While the 3SR/NASBA, and Qβ systems are all able to generate a large quantity of signal, one or more of the enzymes involved in each cannot be used at high temperature (i.e., >55 degrees C.). Therefore the reaction temperatures cannot be raised to prevent non-specific hybridization of the probes. If probes are shortened in order to make them melt more easily at low temperatures, the likelihood of having more than one perfect match in a complex genome increases. For these reasons, PCR and LCR currently dominate the research field in detection technologies.

The basis of the amplification procedure in the PCR and LCR is the fact that the products of one cycle become usable templates in all subsequent cycles, consequently doubling the population with each cycle. The final yield of any such doubling system can be expressed as: $(1+X)^n=y$, where "X" is the mean efficiency (percent copied in each cycle), "n" is the number of cycles, and "y" is the overall efficiency, or yield of the reaction. If every copy of a target DNA is utilized as a template in every cycle of a polymerase chain reaction, then the mean efficiency is 100%. If 20 cycles of PCR are performed, then the yield will be $2^{20}$, or 1,048,576 copies of the starting material. If the reaction conditions reduce the mean efficiency to 85%, then the yield in those 20 cycles will be only $1.85^{20}$, or 220,513 copies of the starting material. In other words, a PCR running at 85% efficiency will yield only 21% as much final product, compared to a reaction running at 100% efficiency. A reaction that is reduced to 50% mean efficiency will yield less than 1% of the possible product.

In practice, routine polymerase chain reactions rarely achieve the theoretical maximum yield, and PCRs are usually run for more than 20 cycles to compensate for the lower yield. At 50% mean efficiency, it would take 34 cycles to achieve the million-fold amplification theoretically possible in 20, and at lower efficiencies, the number of cycles required becomes prohibitive. In addition, any background products that amplify with a better mean efficiency than the intended target will become the dominant products.

Also, many variables can influence the mean efficiency of PCR, including target DNA length and secondary structure, primer length and design, primer and dNTP concentrations, and buffer composition, to name but a few. Contamination of the reaction with exogenous DNA (e.g., DNA spilled onto lab surfaces) or cross-contamination is also a major consideration. Reaction conditions must be carefully optimized for each different primer pair and target sequence, and the process can take days, even for an experienced investigator. The laboriousness of this process, including numerous technical considerations and other factors, presents a significant drawback to using PCR in the clinical setting. Indeed, PCR has yet to penetrate the clinical market in a significant way. The same concerns arise with LCR, as LCR must also be optimized to use different oligonucleotide sequences for each target sequence. In addition, both methods require expensive equipment, capable of precise temperature cycling.

Many applications of nucleic acid detection technologies, such as in studies of allelic variation, involve not only detection of a specific sequence in a complex background, but also the discrimination between sequences with few, or single, nucleotide differences. One method of the detection of allele-specific variants by PCR is based upon the fact that it is difficult for Taq polymerase to synthesize a DNA strand when there is a mismatch between the template strand and the 3' end of the primer. An allele-specific variant may be detected by the use of a primer that is perfectly matched with only one of the possible alleles; the mismatch to the other allele acts to prevent the extension of the primer, thereby preventing the amplification of that sequence. This method has a substantial limitation in that the base composition of the mismatch influences the ability to prevent extension across the mismatch, and certain mismatches do not prevent extension or have only a minimal effect.

A similar 3'-mismatch strategy is used with greater effect to prevent ligation in the LCR. Any mismatch effectively blocks the action of the thermostable ligase, but LCR still has the drawback of target-independent background ligation products initiating the amplification. Moreover, the combination of PCR with subsequent LCR to identify the nucleotides at individual positions is also a clearly cumbersome proposition for the clinical laboratory.

The direct detection method according to various preferred embodiments of the present invention may be, for example a cycling probe reaction (CPR) or a branched DNA analysis.

When a sufficient amount of a nucleic acid to be detected is available, there are advantages to detecting that sequence directly, instead of making more copies of that target, (e.g., as in PCR and LCR). Most notably, a method that does not amplify the signal exponentially is more amenable to quantitative analysis. Even if the signal is enhanced by attaching multiple dyes to a single oligonucleotide, the correlation between the final signal intensity and amount of target is direct. Such a system has an additional advantage that the products of the reaction will not themselves promote further reaction, so contamination of lab surfaces by the products is not as much of a concern. Recently devised techniques have sought to eliminate the use of radioactivity and/or improve the sensitivity in automatable formats. Two examples are the "Cycling Probe Reaction" (CPR), and "Branched DNA" (bDNA).

Cycling probe reaction (CPR): The cycling probe reaction (CPR), uses a long chimeric oligonucleotide in which a central portion is made of RNA while the two termini are made of DNA. Hybridization of the probe to a target DNA and exposure to a thermostable RNase H causes the RNA portion to be digested. This destabilizes the remaining DNA portions of the duplex, releasing the remainder of the probe from the target DNA and allowing another probe molecule to repeat the process. The signal, in the form of cleaved probe molecules, accumulates at a linear rate. While the repeating process increases the signal, the RNA portion of the oligonucleotide is vulnerable to RNases that may carried through sample preparation.

Branched DNA: Branched DNA (bDNA), involves oligonucleotides with branched structures that allow each individual oligonucleotide to carry 35 to 40 labels (e.g., alkaline phosphatase enzymes). While this enhances the signal from a hybridization event, signal from non-specific binding is similarly increased.

The detection of at least one sequence change according to various preferred embodiments of the present invention may be accomplished by, for example restriction fragment length polymorphism (RFLP analysis), allele specific oligonucleotide (ASO) analysis, Denaturing/Temperature Gradient Gel Electrophoresis (DGGE/TGGE), Single-Strand Conformation Polymorphism (SSCP) analysis or Dideoxy fingerprinting (ddF).

The demand for tests which allow the detection of specific nucleic acid sequences and sequence changes is growing rapidly in clinical diagnostics. As nucleic acid sequence data for genes from humans and pathogenic organisms accumulates, the demand for fast, cost-effective, and easy-to-use tests for as yet mutations within specific sequences is rapidly increasing.

A handful of methods have been devised to scan nucleic acid segments for mutations. One option is to determine the entire gene sequence of each test sample (e.g., a bacterial isolate). For sequences under approximately 600 nucleotides, this may be accomplished using amplified material (e.g., PCR reaction products). This avoids the time and expense associated with cloning the segment of interest. However, specialized equipment and highly trained personnel are required, and the method is too labor-intense and expensive to be practical and effective in the clinical setting.

In view of the difficulties associated with sequencing, a given segment of nucleic acid may be characterized on several other levels. At the lowest resolution, the size of the molecule can be determined by electrophoresis by comparison to a known standard run on the same gel. A more detailed picture of the molecule may be achieved by cleavage with combinations of restriction enzymes prior to electrophoresis, to allow construction of an ordered map. The presence of specific sequences within the fragment can be detected by hybridization of a labeled probe, or the precise nucleotide sequence can be determined by partial chemical degradation or by primer extension in the presence of chain-terminating nucleotide analogs.

Restriction fragment length polymorphism (RFLP): For detection of single-base differences between like sequences, the requirements of the analysis are often at the highest level of resolution. For cases in which the position of the nucleotide in question is known in advance, several methods have been developed for examining single base changes without direct sequencing. For example, if a mutation of interest happens to fall within a restriction recognition sequence, a change in the pattern of digestion can be used as a diagnostic tool (e.g., restriction fragment length polymorphism [RFLP] analysis).

Single point mutations have been also detected by the creation or destruction of RFLPs. Mutations are detected and localized by the presence and size of the RNA fragments generated by cleavage at the mismatches. Single nucleotide mismatches in DNA heteroduplexes are also recognized and cleaved by some chemicals, providing an alternative strategy to detect single base substitutions, generically named the "Mismatch Chemical Cleavage" (MCC). However, this method requires the use of osmium tetroxide and piperidine, two highly noxious chemicals which are not suited for use in a clinical laboratory.

RFLP analysis suffers from low sensitivity and requires a large amount of sample. When RFLP analysis is used for the detection of point mutations, it is, by its nature, limited to the detection of only those single base changes which fall within a restriction sequence of a known restriction endonuclease. Moreover, the majority of the available enzymes have 4 to 6 base-pair recognition sequences, and cleave too frequently for many large-scale DNA manipulations. Thus, it is applicable only in a small fraction of cases, as most mutations do not fall within such sites.

A handful of rare-cutting restriction enzymes with 8 base-pair specificities have been isolated and these are widely used in genetic mapping, but these enzymes are few in number, are limited to the recognition of G+C-rich sequences, and cleave at sites that tend to be highly clustered. Recently, endonucleases encoded by group I introns have been discovered that might have greater than 12 base-pair specificity, but again, these are few in number.

Allele specific oligonucleotide (ASO): If the change is not in a recognition sequence, then allele-specific oligonucleotides (ASOs), can be designed to hybridize in proximity to the mutated nucleotide, such that a primer extension or ligation event can bused as the indicator of a match or a mis-match. Hybridization with radioactively labeled allelic specific oligonucleotides (ASO) also has been applied to the detection of specific point mutations. The method is based on the differences in the melting temperature of short DNA fragments differing by a single nucleotide. Stringent hybridization and washing conditions can differentiate between mutant and wild-type alleles. The ASO approach applied to PCR products also has been extensively utilized by various researchers to detect and characterize point mutations in ras genes and gsp/gip oncogenes. Because of the presence of various nucleotide changes in multiple positions, the ASO method requires the use of many oligonucleotides to cover all possible oncogenic mutations.

With either of the techniques described above (i.e., RFLP and ASO), the precise location of the suspected mutation must be known in advance of the test. That is to say, they are inapplicable when one needs to detect the presence of a mutation within a gene or sequence of interest.

Denaturing/Temperature Gradient Gel Electrophoresis (DGGE/TGGE): Two other methods rely on detecting changes in electrophoretic mobility in response to minor sequence changes. One of these methods, termed "Denaturing Gradient Gel Electrophoresis" (DGGE) is based on the observation that slightly different sequences will display different patterns of local melting when electrophoretically resolved on a gradient gel. In this manner, variants can be distinguished, as differences in melting properties of homoduplexes versus heteroduplexes differing in a single nucleotide can detect the presence of mutations in the target sequences because of the corresponding changes in their electrophoretic mobilities. The fragments to be analyzed, usually PCR products, are "clamped" at one end by a long stretch of G-C base pairs (30-80) to allow complete denaturation of the sequence of interest without complete dissociation of the strands. The attachment of a GC "clamp" to the DNA fragments increases the fraction of mutations that can be recognized by DGGE. Attaching a GC clamp to one primer is critical to ensure that the amplified sequence has a low dissociation temperature. Modifications of the technique have been developed, using temperature gradients, and the method can be also applied to RNA:RNA duplexes.

Limitations on the utility of DGGE include the requirement that the denaturing conditions must be optimized for each type of DNA to be tested. Furthermore, the method requires specialized equipment to prepare the gels and maintain the needed high temperatures during electrophoresis. The expense associated with the synthesis of the clamping tail on one oligonucleotide for each sequence to be tested is also a major consideration. In addition, long running times are required for DGGE. The long running time of DGGE was shortened in a modification of DGGE called constant denaturant gel electrophoresis (CDGE). CDGE requires that gels be performed under different denaturant conditions in order to reach high efficiency for the detection of mutations.

A technique analogous to DGGE, termed temperature gradient gel electrophoresis (TGGE), uses a thermal gradient rather than a chemical denaturant gradient. TGGE requires the use of specialized equipment which can generate a temperature gradient perpendicularly oriented relative to the electrical field. TGGE can detect mutations in relatively small fragments of DNA therefore scanning of large gene segments requires the use of multiple PCR products prior to running the gel.

Single-Strand Conformation Polymorphism (SSCP): Another common method, called "Single-Strand Conformation Polymorphism" (SSCP) was developed by Hayashi, Sekya and colleagues and is based on the observation that single strands of nucleic acid can take on characteristic conformations in non-denaturing conditions, and these conformations influence electrophoretic mobility. The complementary strands assume sufficiently different structures that one strand may be resolved from the other. Changes in sequences within the fragment will also change the conformation, consequently altering the mobility and allowing this to be used as an assay for sequence variations.

The SSCP process involves denaturing a DNA segment (e.g., a PCR product) that is labeled on both strands, followed by slow electrophoretic separation on a nondenaturing polyacrylamide gel, so that intra-molecular interactions can form and not be disturbed during the run. This technique is extremely sensitive to variations in gel composition and temperature. A serious limitation of this method is the relative difficulty encountered in comparing data generated in different laboratories, under apparently similar conditions.

Dideoxy fingerprinting (ddF): The dideoxy fingerprinting (ddF) is another technique developed to scan genes for the presence of mutations. The ddF technique combines components of Sanger dideoxy sequencing with SSCP. A dideoxy sequencing reaction is performed using one dideoxy terminator and then the reaction products are electrophoresed on nondenaturing polyacrylamide gels to detect alterations in mobility of the termination segments as in SSCP analysis. While ddF is an improvement over SSCP in terms of increased sensitivity, ddF requires the use of expensive dideoxynucleotides and this technique is still limited to the analysis of fragments of the size suitable for SSCP (i.e., fragments of 200-300 bases for optimal detection of mutations).

In addition to the above limitations, all of these methods are limited as to the size of the nucleic acid fragment that can be analyzed. For the direct sequencing approach, sequences of greater than 600 base pairs require cloning, with the consequent delays and expense of either deletion sub-cloning or primer walking, in order to cover the entire fragment. SSCP and DGGE have even more severe size limitations. Because of reduced sensitivity to sequence changes, these methods are not considered suitable for larger fragments. Although SSCP is reportedly able to detect 90% of single-base substitutions within a 200 base-pair fragment, the detection drops to less than 50% for 400 base pair fragments. Similarly, the sensitivity of DGGE decreases as the length of the fragment reaches 500 base-pairs. The ddF technique, as a combination of direct sequencing and SSCP, is also limited by the relatively small size of the DNA that can be screened.

According to a presently preferred embodiment of the present invention the step of searching for any of the nucleic acid sequences described here, in tumor cells or in cells derived from a cancer patient is effected by any suitable technique, including, but not limited to, nucleic acid sequencing, polymerase chain reaction, ligase chain reaction, self-sustained synthetic reaction, Qβ-Replicase, cycling probe reaction, branched DNA, restriction fragment length polymorphism analysis, mismatch chemical cleavage, heteroduplex analysis, allele-specific oligonucleotides, denaturing gradient gel electrophoresis, constant denaturant gel electrophoresis, temperature gradient gel electrophoresis and dideoxy fingerprinting.

Detection may also optionally be performed with a chip or other such device. The nucleic acid sample which includes the candidate region to be analyzed is preferably isolated, amplified and labeled with a reporter group. This reporter group can be a fluorescent group such as phycoerythrin. The labeled nucleic acid is then incubated with the probes immobilized on the chip using a fluidics station, describe the fabrication of fluidics devices and particularly microcapillary devices, in silicon and glass substrates.

Once the reaction is completed, the chip is inserted into a scanner and patterns of hybridization are detected. The hybridization data is collected, as a signal emitted from the reporter groups already incorporated into the nucleic acid, which is now bound to the probes attached to the chip. Since the sequence and position of each probe immobilized on the chip is known, the identity of the nucleic acid hybridized to a given probe can be determined.

It will be appreciated that when utilized along with automated equipment, the above described detection methods can be used to screen multiple samples for a disease and/or pathological condition both rapidly and easily.

Amino Acid Sequences and Peptides

The terms "polypeptide," "peptide" and "protein" are used interchangeably herein to refer to a polymer of amino acid residues. The terms apply to amino acid polymers in which one or more amino acid residue is an analog or mimetic of a corresponding naturally occurring amino acid, as well as to naturally occurring amino acid polymers. Polypeptides can be modified, e.g., by the addition of carbohydrate residues to form glycoproteins. The terms "polypeptide," "peptide" and "protein" include glycoproteins, as well as non-glycoproteins.

Polypeptide products can be biochemically synthesized such as by employing standard solid phase techniques. Such methods include but are not limited to exclusive solid phase synthesis, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Solid phase polypeptide synthesis procedures are well known in the art and further described by John Morrow Stewart and Janis Dillaha Young, Solid Phase Peptide Syntheses (2nd Ed., Pierce Chemical Company, 1984).

Synthetic polypeptides can optionally be purified by preparative high performance liquid chromatography [Creighton T. (1983) Proteins, structures and molecular principles. WH Freeman and Co. N.Y.], after which their composition can be confirmed via amino acid sequencing.

In cases where large amounts of a polypeptide are desired, it can be generated using recombinant techniques such as described by Bitter et al., (1987) Methods in Enzymol. 153:516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463.

The present invention also encompasses polypeptides encoded by the polynucleotide sequences of the present invention, as well as polypeptides according to the amino acid sequences described herein. The present invention also encompasses homologues of these polypeptides, such homologues can be at least 50%, at least 55%, at least 60%, at least 65%, at least 70%, at least 75%, at least 80%, at least 85%, at least 95% or more say 100% homologous to the amino acid sequences set forth below, as can be determined using BlastP software of the National Center of Biotechnology Information (NCBI) using default parameters, optionally and preferably including the following: filtering on (this option filters repetitive or low-complexity sequences from the query using the Seg (protein) program), scoring matrix is BLOSUM62 for proteins, word size is 3, E value is 10, gap costs are 11, 1 (initialization and extension), and number of alignments shown is 50. Optionally and preferably, nucleic acid sequence identity/homology is determined with BlastN software of the National Center of Biotechnology Information (NCBI) using default parameters, which preferably include using the DUST filter program, and also preferably include having an E value of 10, filtering low complexity sequences and a word size of 11. Finally, the present invention also encompasses fragments of the above described polypeptides and polypeptides having mutations, such as deletions, insertions or substitutions of one or more amino acids, either naturally occurring or artificially induced, either randomly or in a targeted fashion.

It will be appreciated that peptides identified according the present invention may be degradation products, synthetic peptides or recombinant peptides as well as peptidomimetics, typically, synthetic peptides and peptoids and semipeptoids which are peptide analogs, which may have, for example, modifications rendering the peptides more stable while in a body or more capable of penetrating into cells. Such modifications include, but are not limited to N terminus modification, C terminus modification, peptide bond modification, including, but not limited to, CH2-NH, CH2-S, CH2-S=O, O=C—NH, CH2-O, CH2-CH2, S=C—NH, CH=CH or CF=CH, backbone modifications, and residue modification. Methods for preparing peptidomimetic compounds are well known in the art and are specified. Further details in this respect are provided hereinunder.

Peptide bonds (—CO—NH—) within the peptide may be substituted, for example, by N-methylated bonds (—N(CH3)-CO—), ester bonds (—C(R)H—C—O—O—C(R)—N—), ketomethylen bonds (—CO—CH2-), α-aza bonds (—NH—N(R)—CO—), wherein R is any alkyl, e.g., methyl, carba bonds (—CH2-NH—), hydroxyethylene bonds (—CH(OH)—CH2-), thioamide bonds (—CS—NH—), olefinic double bonds (—CH=CH—), retro amide bonds (—NH—CO—), peptide derivatives (—N(R)—CH2-CO—), wherein R is the "normal" side chain, naturally presented on the carbon atom.

These modifications can occur at any of the bonds along the peptide chain and even at several (2-3) at the same time.

Natural aromatic amino acids, Trp, Tyr and Phe, may be substituted for synthetic non-natural acid such as Phenylglycine, TIC, naphthylelanine (Nol), ring-methylated derivatives of Phe, halogenated derivatives of Phe or o-methyl-Tyr.

In addition to the above, the peptides of the present invention may also include one or more modified amino acids or one or more non-amino acid monomers (e.g. fatty acids, complex carbohydrates etc).

As used herein in the specification and in the claims section below the term "amino acid" or "amino acids" is understood to include the 20 naturally occurring amino acids; those amino acids often modified post-translationally in vivo, including, for example, hydroxyproline, phosphoserine and phosphothreonine; and other unusual amino acids including, but not limited to, 2-aminoadipic acid, hydroxylysine, isodesmosine, nor-valine, nor-leucine and ornithine. Furthermore, the term "amino acid" includes both D- and L-amino acids.

Table I non-conventional or modified amino acids which can be used with the present invention.

TABLE 1

| Non-conventional amino acid | Code |
| --- | --- |
| α-aminobutyric acid | Abu |
| α-amino-α-methylbutyrate | Mgabu |
| aminocyclopropane- | Cpro |

TABLE 1-continued

| Non-conventional amino acid | Code |
| --- | --- |
| Carboxylate aminoisobutyric acid | Aib |
| aminonorbornyl-Carboxylate | Norb |
| Cyclohexylalanine | Chexa |
| Cyclopentylalanine | Cpen |
| D-alanine | Dal |
| D-arginine | Darg |
| D-aspartic acid | Dasp |
| D-cysteine | Dcys |
| D-glutamine | Dgln |
| D-glutamic acid | Dglu |
| D-histidine | Dhis |
| D-isoleucine | Dile |
| D-leucine | Dleu |
| D-lysine | Dlys |
| D-methionine | Dmet |
| D-ornithine | Dorn |
| D-phenylalanine | Dphe |
| D-proline | Dpro |
| D-serine | Dser |
| D-threonine | Dthr |
| D-tryptophan | Dtrp |
| D-tyrosine | Dtyr |
| D-valine | Dval |
| D-α-methylalanine | Dmala |
| D-α-methylarginine | Dmarg |
| D-α-methylasparagine | Dmasn |
| D-α-methylaspartate | Dmasp |
| D-α-methylcysteine | Dmcys |
| D-α-methylglutamine | Dmgln |
| D-α-methylhistidine | Dmhis |
| D-α-methylisoleucine | Dmile |
| D-α-methylleucine | Dmleu |
| D-α-methyllysine | Dmlys |
| D-α-methylmethionine | Dmmet |
| D-α-methylornithine | Dmorn |
| D-α-methylphenylalanine | Dmphe |
| D-α-methylproline | Dmpro |
| D-α-methylserine | Dmser |
| D-α-methylthreonine | Dmthr |
| D-α-methyltryptophan | Dmtrp |
| D-α-methyltyrosine | Dmty |
| D-α-methylvaline | Dmval |
| D-α-methylalnine | Dnmala |
| D-α-methylarginine | Dnmarg |
| D-α-methylasparagine | Dnmasn |
| D-α-methylasparatate | Dnmasp |
| D-α-methylcysteine | Dnmcys |
| D-N-methylleucine | Dnmleu |
| D-N-methyllysine | Dnmlys |
| N-methylcyclohexylalanine | Nmchexa |
| D-N-methylornithine | Dnmorn |
| N-methylglycine | Nala |
| N-methylaminoisobutyrate | Nmaib |
| N-(1-methylpropyl)glycine | Nile |
| N-(2-methylpropyl)glycine | Nleu |
| D-N-methyltryptophan | Dnmtrp |
| D-N-methyltyrosine | Dnmtyr |
| D-N-methylvaline | Dnmval |
| γ-aminobutyric acid | Gabu |
| L-t-butylglycine | Tbug |
| L-ethylglycine | Etg |
| L-homophenylalanine | Hphe |
| L-α-methylarginine | Marg |
| L-α-methylaspartate | Masp |
| L-α-methylcysteine | Mcys |
| L-α-methylglutamine | Mgln |
| L-α-methylhistidine | Mhis |
| L-α-methylisoleucine | Mile |
| D-N-methylglutamine | Dnmgln |
| D-N-methylglutamate | Dnmglu |
| D-N-methylhistidine | Dnmhis |
| D-N-methylisoleucine | Dnmile |
| D-N-methylleucine | Dnmleu |
| D-N-methyllysine | Dnmlys |

| Non-conventional amino acid | Code |
| --- | --- |
| N-methylcyclohexylalanine | Nmchexa |
| D-N-methylornithine | Dnmorn |
| N-methylglycine | Nala |
| N-methylaminoisobutyrate | Nmaib |
| N-(1-methylpropyl)glycine | Nile |
| N-(2-methylpropyl)glycine | Nleu |
| D-N-methyltryptophan | Dnmtrp |
| D-N-methyltyrosine | Dnmtyr |
| D-N-methylvaline | Dnmval |
| γ-aminobutyric acid | Gabu |
| L-t-butylglycine | Tbug |
| L-ethylglycine | Etg |
| L-homophenylalanine | Hphe |
| L-α-methylarginine | Marg |
| L-α-methylaspartate | Masp |
| L-α-methylcysteine | Mcys |
| L-α-methylglutamine | Mgln |
| L-α-methylhistidine | Mhis |
| L-α-methylisoleucine | Mile |
| L-α-methylleucine | Mleu |
| L-α-methylmethionine | Mmet |
| L-α-methylnorvaline | Mnva |
| L-α-methylphenylalanine | Mphe |
| L-α-methylserine | Mser |
| L-α-methylvaline | Mtrp |
| L-α-methylleucine | Mval |
|  | Nnbhm |
| N-(N-(2,2-diphenylethyl) carbamylmethyl-glycine | Nnbhm |
| 1-carboxy-1-(2,2-diphenyl ethylamino)cyclopropane | Nmbc |
| L-N-methylalanine | Nmala |
| L-N-methylarginine | Nmarg |
| L-N-methylasparagine | Nmasn |
| L-N-methylaspartic acid | Nmasp |
| L-N-methylcysteine | Nmcys |
| L-N-methylglutamine | Nmgln |
| L-N-methylglutamic acid | Nmglu |
| L-N-methylhistidine | Nmhis |
| L-N-methylisolleucine | Nmile |
| L-N-methylleucine | Nmleu |
| L-N-methyllysine | Nmlys |
| L-N-methylmethionine | Nmmet |
| L-N-methylnorleucine | Nmnle |
| L-N-methylnorvaline | Nmnva |
| L-N-methylornithine | Nmorn |
| L-N-methylphenylalanine | Nmphe |
| L-N-methylproline | Nmpro |
| L-N-methylserine | Nmser |
| L-N-methylthreonine | Nmthr |
| L-N-methyltryptophan | Nmtrp |
| L-N-methyltyrosine | Nmtyr |
| L-N-methylvaline | Nmval |
| L-N-methylethylglycine | Nmetg |
| L-N-methyl-t-butylglycine | Nmtbug |
| L-norleucine | Nle |
| L-norvaline | Nva |
| α-methyl-aminoisobutyrate | Maib |
| α-methyl-γ-aminobutyrate | Mgabu |
| α-methylcyclohexylalanine | Mchexa |
| α-methylcyclopentylalanine | Mcpen |
| α-methyl-α-napthylalanine | Manap |
| α-methylpenicillamine | Mpen |
| N-(4-aminobutyl)glycine | Nglu |
| N-(2-aminoethyl)glycine | Naeg |
| N-(3-aminopropyl)glycine | Norn |
| N-amino-α-methylbutyrate | Nmaabu |
| α-napthylalanine | Anap |
| N-benzylglycine | Nphe |
| N-(2-carbamylethyl)glycine | Ngln |
| N-(carbamylmethyl)glycine | Nasn |
| N-(2-carboxyethyl)glycine | Nglu |
| N-(carboxymethyl)glycine | Nasp |
| N-cyclobutylglycine | Ncbut |
| N-cycloheptylglycine | Nchep |
| N-cyclohexylglycine | Nchex |
| N-cyclodecylglycine | Ncdec |

TABLE 1-continued

| Non-conventional amino acid | Code |
| --- | --- |
| N-cyclododeclglycine | Ncdod |
| N-cyclooctylglycine | Ncoct |
| N-cyclopropylglycine | Ncpro |
| N-cycloundecylglycine | Ncund |
| N-(2,2-diphenylethyl)glycine | Nbhm |
| N-(3,3-diphenylpropyl)glycine | Nbhe |
| N-(3-indolylyethyl) glycine | Nhtrp |
| N-methyl-γ-aminobutyrate | Nmgabu |
| D-N-methylmethionine | Dnmmet |
| N-methylcyclopentylalanine | Nmcpen |
| D-N-methylphenylalanine | Dnmphe |
| D-N-methylproline | Dnmpro |
| D-N-methylserine | Dnmser |
| D-N-methylserine | Dnmser |
| D-N-methylthreonine | Dnmthr |
| N-(1-methylethyl)glycine | Nva |
| N-methyla-napthylalanine | Nmanap |
| N-methylpenicillamine | Nmpen |
| N-(p-hydroxyphenyl)glycine | Nhtyr |
| N-(thiomethyl)glycine | Ncys |
| Penicillamine | Pen |
| L-α-methylalanine | Mala |
| L-α-methylasparagine | Masn |
| L-α-methyl-t-butylglycine | Mtbug |
| L-methylethylglycine | Metg |
| L-α-methylglutamate | Mglu |
| L-α-methylhomophenylalanine | Mhphe |
| N-(2-methylthioethyl)glycine | Nmet |
| N-(3-guanidinopropyl)glycine | Narg |
| N-(1-hydroxyethyl)glycine | Nthr |
| N-(hydroxyethyl)glycine | Nser |
| N-(imidazolylethyl)glycine | Nhis |
| N-(3-indolylyethyl)glycine | Nhtrp |
| N-methyl-γ-aminobutyrate | Nmgabu |
| D-N-methylmethionine | Dnmmet |
| N-methylcyclopentylalanine | Nmcpen |
| D-N-methylphenylalanine | Dnmphe |
| D-N-methylproline | Dnmpro |
| D-N-methylserine | Dnmser |
| D-N-methylthreonine | Dnmthr |
| N-(1-methylethyl)glycine | Nval |
| N-methyla-napthylalanine | Nmanap |
| N-methylpenicillamine | Nmpen |
| N-(p-hydroxyphenyl)glycine | Nhtyr |
| N-(thiomethyl)glycine | Ncys |
| Penicillamine | Pen |
| L-α-methylalanine | Mala |
| L-α-methylasparagine | Masn |
| L-α-methyl-t-butylglycine | Mtbug |
| L-methylethylglycine | Metg |
| L-α-methylglutamate | Mglu |
| L-α-methylhomophenylalanine | Mhphe |
| N-(2-methylthioethyl)glycine | Nmet |
| L-α-methyllysine | Mlys |
| L-α-methylnorleucine | Mnle |
| L-α-methylornithine | Morn |
| L-α-methylproline | Mpro |
| L-α-methylthreonine | Mthr |
| L-α-methyltyrosine | Mtyr |
| L-N-methylhomophenylalanine | Nmhphe |
| N-(N-(3,3-diphenylpropyl) Carbamylmethyl(1)glycine | Nnbhe |

Since the peptides of the present invention are preferably utilized in diagnostics which require the peptides to be in soluble form, the peptides of the present invention preferably include one or more non-natural or natural polar amino acids, including but not limited to serine and threonine which are capable of increasing peptide solubility due to their hydroxyl-containing side chain.

The peptides of the present invention are preferably utilized in a linear form, although it will be appreciated that in cases where cyclicization does not severely interfere with peptide characteristics, cyclic forms of the peptide can also be utilized.

The peptides of present invention can be biochemically synthesized such as by using standard solid phase techniques. These methods include exclusive solid phase synthesis well known in the art, partial solid phase synthesis methods, fragment condensation, classical solution synthesis. These methods are preferably used when the peptide is relatively short (i.e., 10 kDa) and/or when it cannot be produced by recombinant techniques (i.e., not encoded by a nucleic acid sequence) and therefore involves different chemistry.

Synthetic peptides can be purified by preparative high performance liquid chromatography and the composition of which can be confirmed via amino acid sequencing.

In cases where large amounts of the peptides of the present invention are desired, the peptides of the present invention can be generated using recombinant techniques such as described by Bitter et al., (1987) Methods in Enzymol. 153:516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680 and Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463 and also as described above.

Antibodies

"Antibody" refers to a polypeptide ligand that is preferably substantially encoded by an immunoglobulin gene or immunoglobulin genes, or fragments thereof, which specifically binds and recognizes an epitope (e.g., an antigen). The recognized immunoglobulin genes include the kappa and lambda light chain constant region genes, the alpha, gamma, delta, epsilon and mu heavy chain constant region genes, and the myriad-immunoglobulin variable region genes. Antibodies exist, e.g., as intact immunoglobulins or as a number of well characterized fragments produced by digestion with various peptidases. This includes, e.g., Fab' and F(ab)'$_2$ fragments. The term "antibody," as used herein, also includes antibody fragments either produced by the modification of whole antibodies or those synthesized de novo using recombinant DNA methodologies. It also includes polyclonal antibodies, monoclonal antibodies, chimeric antibodies, humanized antibodies, or single chain antibodies. "Fc" portion of an antibody refers to that portion of an immunoglobulin heavy chain that comprises one or more heavy chain constant region domains, CH1, CH2 and CH3, but does not include the heavy chain variable region.

The functional fragments of antibodies, such as Fab, F(ab')2, and Fv that are capable of binding to macrophages, are described as follows: (1) Fab, the fragment which contains a monovalent antigen-binding fragment of an antibody molecule, can be produced by digestion of whole antibody with the enzyme papain to yield an intact light chain and a portion of one heavy chain; (2) Fab', the fragment of an antibody molecule that can be obtained by treating whole antibody with pepsin, followed by reduction, to yield an intact light chain and a portion of the heavy chain; two Fab' fragments are obtained per antibody molecule; (3) (Fab')2, the fragment of the antibody that can be obtained by treating whole antibody with the enzyme pepsin without subsequent reduction; F(ab')2 is a dimer of two Fab' fragments held together by two disulfide bonds; (4) Fv, defined as a genetically engineered fragment containing the variable region of the light chain and the variable region of the heavy chain expressed as two chains; and (5) Single chain antibody ("SCA"), a genetically engineered molecule containing the variable region of the light chain and the variable region of the heavy chain, linked by a suitable polypeptide linker as a genetically fused single chain molecule.

Methods of producing polyclonal and monoclonal antibodies as well as fragments thereof are well known in the art (See for example, Harlow and Lane, Antibodies: A Laboratory Manual, Cold Spring Harbor Laboratory, New York, 1988, incorporated herein by reference).

Antibody fragments according to the present invention can be prepared by proteolytic hydrolysis of the antibody or by expression in E. coli or mammalian cells (e.g. Chinese hamster ovary cell culture or other protein expression systems) of DNA encoding the fragment. Antibody fragments can be obtained by pepsin or papain digestion of whole antibodies by conventional methods. For example, antibody fragments can be produced by enzymatic cleavage of antibodies with pepsin to provide a 5S fragment denoted F(ab')2. This fragment can be further cleaved using a thiol reducing agent, and optionally a blocking group for the sulfhydryl groups resulting from cleavage of disulfide linkages, to produce 3.5S Fab' monovalent fragments. Alternatively, an enzymatic cleavage using pepsin produces two monovalent Fab' fragments and an Fc fragment directly. These methods are described, for example, by Goldenberg, U.S. Pat. Nos. 4,036,945 and 4,331,647, and references contained therein, which patents are hereby incorporated by reference in their entirety. See also Porter, R. R. [Biochem. J. 73: 119-126 (1959)]. Other methods of cleaving antibodies, such as separation of heavy chains to form monovalent light-heavy chain fragments, further cleavage of fragments, or other enzymatic, chemical, or genetic techniques may also be used, so long as the fragments bind to the antigen that is recognized by the intact antibody.

Fv fragments comprise an association of VH and VL chains. This association may be noncovalent, as described in Inbar et al. [Proc. Nat'l Acad. Sci. USA 69:2659-62 (19720]. Alternatively, the variable chains can be linked by an intermolecular disulfide bond or cross-linked by chemicals such as glutaraldehyde. Preferably, the Fv fragments comprise VH and VL chains connected by a peptide linker. These single-chain antigen binding proteins (sFv) are prepared by constructing a structural gene comprising DNA sequences encoding the VH and VL domains connected by an oligonucleotide. The structural gene is inserted into an expression vector, which is subsequently introduced into a host cell such as E. coli. The recombinant host cells synthesize a single polypeptide chain with a linker peptide bridging the two V domains. Methods for producing sFvs are described, for example, by [Whitlow and Filpula, Methods 2: 97-105 (1991); Bird et al., Science 242:423-426 (1988); Pack et al., Bio/Technology 11:1271-77 (1993); and U.S. Pat. No. 4,946,778, which is hereby incorporated by reference in its entirety.

Another form of an antibody fragment is a peptide coding for a single complementarity-determining region (CDR). CDR peptides ("minimal recognition units") can be obtained by constructing genes encoding the CDR of an antibody of interest. Such genes are prepared, for example, by using the polymerase chain reaction to synthesize the variable region from RNA of antibody-producing cells. See, for example, Larrick and Fry [Methods, 2: 106-10 (1991)].

Humanized forms of non-human (e.g., murine) antibodies are chimeric molecules of immunoglobulins, immunoglobulin chains or fragments thereof (such as Fv, Fab, Fab', F(ab') or other antigen-binding subsequences of antibodies) which contain minimal sequence derived from non-human immunoglobulin. Humanized antibodies include human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Humanized antibodies may also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin [Jones et al., Nature, 321:522-525 (1986); Riechmann et al., Nature, 332:323-329 (1988); and Presta, Curr. Op. Struct. Biol., 2:593-596 (1992)].

Methods for humanizing non-human antibodies are well known in the art. Generally, a humanized antibody has one or more amino acid residues introduced into it from a source which is non-human. These non-human amino acid residues are often referred to as import residues, which are typically taken from an import variable domain. Humanization can be essentially performed following the method of Winter and co-workers [Jones et al., Nature, 321:522-525 (1986); Riechmann et al., Nature 332:323-327 (1988); Verhoeyen et al., Science, 239:1534-1536 (1988)], by substituting rodent CDRs or CDR sequences for the corresponding sequences of a human antibody. Accordingly, such humanized antibodies are chimeric antibodies (U.S. Pat. No. 4,816,567), wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

Human antibodies can also be produced using various techniques known in the art, including phage display libraries [Hoogenboom and Winter, J. Mol. Biol., 227:381 (1991); Marks et al., J. Mol. Biol., 222:581 (1991)]. The techniques of Cole et al. and Boemer et al. are also available for the preparation of human monoclonal antibodies (Cole et al., Monoclonal Antibodies and Cancer Therapy, Alan R. Liss, p. 77 (1985) and Boemer et al., J. Immunol., 147(1):86-95 (1991)]. Similarly, human antibodies can be made by introduction of human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in the following scientific publications: Marks et al., Bio/Technology 10,: 779-783 (1992); Lonberg et al., Nature 368: 856-859 (1994); Morrison, Nature 368 812-13 (1994); Fishwild et al., Nature Biotechnology 14, 845-51 (1996); Neuberger, Nature Biotechnology 14: 826 (1996); and Lonberg and Huszar, Intern. Rev. Immunol. 13, 65-93 (1995).

Preferably, the antibody of this aspect of the present invention specifically binds at least one epitope of the polypeptide variants of the present invention. As used herein, the term "epitope" refers to any antigenic determinant on an antigen to which the paratope of an antibody binds.

Epitopic determinants usually consist of chemically active surface groupings of molecules such as amino acids or carbohydrate side chains and usually have specific three dimensional structural characteristics, as well as specific charge characteristics.

Optionally, a unique epitope may be created in a variant due to a change in one or more post-translational modifications, including but not limited to glycosylation and/or phosphorylation, as described below. Such a change may also cause a new epitope to be created, for example through removal of glycosylation at a particular site.

An epitope according to the present invention may also optionally comprise part or all of a unique sequence portion of a variant according to the present invention in combination with at least one other portion of the variant which is not contiguous to the unique sequence portion in the linear polypeptide itself, yet which are able to form an epitope in combination. One or more unique sequence portions may optionally combine with one or more other non-contiguous portions of the variant (including a portion which may have high homology to a portion of the known protein) to form an epitope.

Immunoassays

In another embodiment of the present invention, an immunoassay can be used to qualitatively or quantitatively detect and analyze markers in a sample. This method comprises: providing an antibody that specifically binds to a marker; contacting a sample with the antibody; and detecting the presence of a complex of the antibody bound to the marker in the sample.

To prepare an antibody that specifically binds to a marker, purified protein markers can be used. Antibodies that specifically bind to a protein marker can be prepared using any suitable methods known in the art.

After the antibody is provided, a marker can be detected and/or quantified using any of a number of well recognized immunological binding assays. Useful assays include, for example, an enzyme immune assay (EIA) such as enzyme-linked immunosorbent assay (ELISA), a radioimmune assay (RIA), a Western blot assay, or a slot blot assay see, e.g., U.S. Pat. Nos. 4,366,241; 4,376,110; 4,517,288; and 4,837,168). Generally, a sample obtained from a subject can be contacted with the antibody that specifically binds the marker.

Optionally, the antibody can be fixed to a solid support to facilitate washing and subsequent isolation of the complex, prior to contacting the antibody with a sample. Examples of solid supports include but are not limited to glass or plastic in the form of, e.g., a microtiter plate, a stick, a bead, or a microbead. Antibodies can also be attached to a solid support.

After incubating the sample with antibodies, the mixture is washed and the antibody-marker complex formed can be detected. This can be accomplished by incubating the washed mixture with a detection reagent. Alternatively, the marker in the sample can be detected using an indirect assay, wherein, for example, a second, labeled antibody is used to detect bound marker-specific antibody, and/or in a competition or inhibition assay wherein, for example, a monoclonal antibody which binds to a distinct epitope of the marker are incubated simultaneously with the mixture.

Throughout the assays, incubation and/or washing steps may be required after each combination of reagents. Incubation steps can vary from about 5 seconds to several hours, preferably from about 5 minutes to about 24 hours. However, the incubation time will depend upon the assay format, marker, volume of solution, concentrations and the like. Usually the assays will be carried out at ambient temperature, although they can be conducted over a range of temperatures, such as 10° C. to 40° C.

The immunoassay can be used to determine a test amount of a marker in a sample from a subject. First, a test amount of a marker in a sample can be detected using the immunoassay methods described above. If a marker is present in the sample, it will form an antibody-marker complex with an antibody that specifically binds the marker under suitable incubation conditions described above. The amount of an antibody-marker complex can optionally be determined by comparing to a standard. As noted above, the test amount of marker need not be measured in absolute units, as long as the unit of measurement can be compared to a control amount and/or signal.

Preferably used are antibodies which specifically interact with the polypeptides of the present invention and not with wild type proteins or other isoforms thereof, for example. Such antibodies are directed, for example, to the unique sequence portions of the polypeptide variants of the present invention, including but not limited to bridges, heads, tails and insertions described in greater detail below. Preferred embodiments of antibodies according to the present invention are described in greater detail with regard to the section entitled "Antibodies".

Radio-immunoassay (RIA): In one version, this method involves precipitation of the desired substrate and in the methods detailed hereinbelow, with a specific antibody and radiolabelled antibody binding protein (e.g., protein A labeled with $I^{125}$) immobilized on a precipitable carrier such as agarose beads. The number of counts in the precipitated pellet is proportional to the amount of substrate.

In an alternate version of the RIA, a labeled substrate and an unlabelled antibody binding protein are employed. A sample containing an unknown amount of substrate is added in varying amounts. The decrease in precipitated counts from the labeled substrate is proportional to the amount of substrate in the added sample.

Enzyme linked immunosorbent assay (ELISA): This method involves fixation of a sample (e.g., fixed cells or a proteinaceous solution) containing a protein substrate to a surface such as a well of a microtiter plate. A substrate specific antibody coupled to an enzyme is applied and allowed to bind to the substrate. Presence of the antibody is then detected and quantitated by a colorimetric reaction employing the enzyme coupled to the antibody. Enzymes commonly employed in this method include horseradish peroxidase and alkaline phosphatase. If well calibrated and within the linear range of response, the amount of substrate present in the sample is proportional to the amount of color produced. A substrate standard is generally employed to improve quantitative accuracy.

Western blot: This method involves separation of a substrate from other protein by means of an acrylamide gel followed by transfer of the substrate to a membrane (e.g., nylon or PVDF). Presence of the substrate is then detected by antibodies specific to the substrate, which are in turn detected by antibody binding reagents. Antibody binding reagents may be, for example, protein A, or other antibodies.

Antibody binding reagents may be radiolabelled or enzyme linked as described hereinabove. Detection may be by autoradiography, colorimetric reaction or chemiluminescence. This method allows both quantitation of an amount of substrate and determination of its identity by a relative position on the membrane which is indicative of a migration distance in the acrylamide gel during electrophoresis.

Immunohistochemical analysis: This method involves detection of a substrate in situ in fixed cells by substrate specific antibodies. The substrate specific antibodies may be enzyme linked or linked to fluorophores. Detection is by microscopy and subjective evaluation. If enzyme linked antibodies are employed, a colorimetric reaction may be required.

Fluorescence activated cell sorting (FACS): This method involves detection of a substrate in situ in cells by substrate specific antibodies. The substrate specific antibodies are linked to fluorophores. Detection is by means of a cell sorting machine which reads the wavelength of light emitted from each cell as it passes through a light beam. This method may employ two or more antibodies simultaneously.

Radio-Imaging Methods

These methods include but are not limited to, positron emission tomography (PET) single photon emission computed tomography (SPECT). Both of these techniques are non-invasive, and can be used to detect and/or measure a wide variety of tissue events and/or functions, such as detecting cancerous cells for example. Unlike PET, SPECT can optionally be used with two labels simultaneously. SPECT has some other advantages as well, for example with regard to cost and the types of labels that can be used. For example, U.S. Pat. No. 6,696,686 describes the use of SPECT for detection of breast cancer, and is hereby incorporated by reference as if fully set forth herein.

Display Libraries

According to still another aspect of the present invention there is provided a display library comprising a plurality of display vehicles (such as phages, viruses or bacteria) each displaying at least 6, at least 7, at least 8, at least 9, at least 10, 10-15, 12-17, 15-20, 15-30 or 20-50 consecutive amino acids derived from the polypeptide sequences of the present invention.

Methods of constructing such display libraries are well known in the art. Such methods are described in, for example, Young A C, et al., "The three-dimensional structures of a polysaccharide binding antibody to *Cryptococcus neoformans* and its complex with a peptide from a phage display library: implications for the identification of peptide mimotopes" J Mol Biol 1997 Dec. 12;274(4):622-34; Giebel LB et al. "Screening of cyclic peptide phage libraries identifies ligands that bind streptavidin with high affinities" Biochemistry 1995 Nov. 28;34(47):15430-5; Davies E L et al., "Selection of specific phage-display antibodies using libraries derived from chicken immunoglobulin genes" J Immunol Methods 1995 Oct. 12;186(1):125-35; Jones C RT al. "Current trends in molecular recognition and bioseparation" J Chromatogr A 1995 Jul. 14;707(1):3-22; Deng S J et al. "Basis for selection of improved carbohydrate-binding single-chain antibodies from synthetic gene libraries" Proc Natl Acad Sci USA 1995 May 23;92(11):4992-6; and Deng S J et al. "Selection of antibody single-chain variable fragments with improved carbohydrate binding by phage display" J Biol Chem 1994 Apr. 1;269(13):9533-8, which are incorporated herein by reference.

The following sections relate to Candidate Marker Examples.

CANDIDATE MARKER EXAMPLES SECTION

This Section relates to Examples of sequences according to the present invention, including illustrative methods of selection thereof.

Description of the Methodology Undertaken to Uncover the Biomolecular Sequences of the Present Invention Human ESTs and cDNAs were obtained from GenBank versions 136 (Jun. 15, 2003 ftp.ncbi.nih.gov/genbank/release.notes/gb136.release.notes); NCBI genome assembly of April 2003; RefSeq sequences from June 2003; Genbank version 139 (December 2003); Human Genome from NCBI (Build 34) (from October 2003); and RefSeq sequences from December 2003; and the LifeSeq library from Incyte Corporation (Wilmington, Del., USA; ESTs only). With regard to GenBank sequences, the human EST sequences from the EST (GBEST) section and the human mRNA sequences from the primate (GBPRI) section were used; also the human nucleotide RefSeq mRNA sequences were used (see for example www.ncbi.nlm.nih.gov/Genbank/Genbank-Overview.html and for a reference to the EST section, see www.ncbi.nlm.nih.gov/dbEST/; a general reference to dbEST, the EST database in GenBank, may be found in Boguski et al, Nat Genet. 1993 August; 4(4):332-3; all of which are hereby incorporated by reference as if fully set forth herein).

Novel splice variants were predicted using the LEADS clustering and assembly system as described in Sorek, R., Ast, G. & Graur, D. Alu-containing exons are alternatively spliced. Genome Res 12, 1060-7 (2002); U.S. Pat. No. 6,625,545; and U.S. patent application Ser. No. 10/426,002, published as U.S. 20040101876 on May 27, 2004; all of which are hereby incorporated by reference as if fully set forth herein. Briefly, the software cleans the expressed sequences from repeats, vectors and immunoglobulins. It then aligns the expressed sequences to the genome taking alternatively splicing into account and clusters overlapping expressed sequences into "clusters" that represent genes or partial genes.

These were annotated using the GeneCarta (Compugen, Tel-Aviv, Israel) platform. The GeneCarta platform includes a rich pool of annotations, sequence information (particularly of spliced sequences), chromosomal information, alignments, and additional information such as SNPs, gene ontology terms, expression profiles, functional analyses, detailed domain structures, known and predicted proteins and detailed homology reports.

A brief explanation is provided with regard to the method of selecting the candidates. However, it should noted that this explanation is provided for descriptive purposes only, and is not intended to be limiting in any way. The potential markers were identified by a computational process that was designed to find genes and/or their splice variants that are over-expressed in tumor tissues, by using databases of expressed sequences. Various parameters related to the information in the EST libraries, determined according to a manual classification process, were used to assist in locating genes and/or splice variants thereof that are over-expressed in cancerous tissues. The detailed description of the selection method is presented in Example 1 below. The cancer biomarkers selection engine and the following wet validation stages are schematically summarized in FIG. 1.

Example 1

Identification of Differentially Expressed Gene Products—Algorithm

In order to distinguish between differentially expressed gene products and constitutively expressed genes (i.e., house keeping genes) an algorithm based on an analysis of frequencies was configured. A specific algorithm for identification of transcripts over expressed in cancer is described hereinbelow.

Dry Analysis

Library annotation—EST libraries are manually classified according to:

(i) Tissue Origin (ii) Biological source—Examples of frequently used biological sources for construction of EST libraries include cancer cell-lines; normal tissues; cancer tissues; fetal tissues; and others such as normal cell lines and pools of normal cell-lines, cancer cell-lines and combinations thereof. A specific description of abbreviations used below with regard to these tissues/cell lines etc is given above.

(iii) Protocol of library construction—various methods are known in the art for library construction including normalized library construction; non-normalized library construction; subtracted libraries; ORESTES and others. It will be appreciated that at times the protocol of library construction is not indicated in GenBank and/or other library annotaion.

The following rules are followed:

EST libraries originating from identical biological samples are considered as a single library.

EST libraries which included above-average levels of contamination, such as DNA contamination for example, were eliminated. The presence of such contamination was determined as follows. For each library, the number of unspliced ESTs that are not fully contained within other spliced sequences was counted. If the percentage of such sequences (as compared to all other sequences) was at least 4 standard deviations above the average for all libraries being analyzed, this library was tagged as being contaminated and was eliminated from further consideration in the below analysis (see also Sorek, R. & Safer, H. M. A novel algorithm for computational identification of contaminated EST libraries. Nucleic Acids Res 31, 1067-74 (2003) for further details).

Clusters (genes) having at least five sequences including at least two sequences from the tissue of interest were analyzed. Splice variants were identified by using the LEADS software package as described above.

Example 2

Identification of Genes Over Expressed in Cancer.

Two different scoring algorithms were developed.

Libraries score—candidate sequences which are supported by a number of cancer libraries, are more likely to serve as specific and effective diagnostic markers.

The basic algorithm—for each cluster the number of cancer and normal libraries contributing sequences to the cluster was counted. Fisher exact test was used to check if cancer libraries are significantly over-represented in the cluster as compared to the total number of cancer and normal libraries.

Library counting: Small libraries (e.g., less than 1000 sequences) were excluded from consideration unless they participate in the cluster. For this reason, the total number of libraries is actually adjusted for each cluster.

Clones no. score—Generally, when the number of ESTs is much higher in the cancer libraries relative to the normal libraries it might indicate actual over-expression.

The Algorithm—

Clone counting: For counting EST clones each library protocol class was given a weight based on our belief of how much the protocol reflects actual expression levels:

(i) non-normalized: 1

(ii) normalized: 0.2

(iii) all other classes: 0.1

Clones number score—The total weighted number of EST clones from cancer libraries was compared to the EST clones from normal libraries. To avoid cases where one library contributes to the majority of the score, the contribution of the library that gives most clones for a given cluster was limited to 2 clones.

The score was computed as $$\frac{\frac{c+1}{C}}{\frac{n+1}{N}}$$

where:

c—weighted number of "cancer" clones in the cluster.

C—weighted number of clones in all "cancer" libraries.

n—weighted number of "normal" clones in the cluster.

N—weighted number of clones in all "normal" libraries.

Clones number score significance—Fisher exact test was used to check if EST clones from cancer libraries are significantly over-represented in the cluster as compared to the total number of EST clones from cancer and normal libraries.

Two search approaches were used to find either general cancer-specific candidates or tumor specific candidates.

Libraries/sequences originating from tumor tissues are counted as well as libraries originating from cancer cell-lines ("normal" cell-lines were ignored).

Only libraries/sequences originating from tumor tissues are counted

Example 3

Identification of Tissue Specific Genes

For detection of tissue specific clusters, tissue libraries/sequences were compared to the total number of libraries/sequences in cluster. Similar statistical tools to those described in above were employed to identify tissue specific genes. Tissue abbreviations are the same as for cancerous tissues, but are indicated with the header "normal tissue".

The algorithm—for each tested tissue T and for each tested cluster the following were examined:

1. Each cluster includes at least 2 libraries from the tissue T. At least 3 clones (weighed—as described above) from tissue T in the cluster; and 2. Clones from the tissue T are at least 40% from all the clones participating in the tested cluster Fisher exact test P-values were computed both for library and weighted clone counts to check that the counts are statistically significant.

Example 4

Identification of Splice Variants Over Expressed in Cancer of Clusters Which are Not Over Expressed in Cancer Cancer-specific splice variants containing a unique region were identified.

Identification of Unique Sequence Regions in Splice Variants

A Region is defined as a group of adjacent exons that always appear or do not appear together in each splice variant.

A "segment" (sometimes referred also as "seg" or "node") is defined as the shortest contiguous transcribed region without known splicing inside.

Only reliable ESTs were considered for region and segment analysis. An EST was defined as unreliable if:
(i) Unspliced;
(ii) Not covered by RNA;
(iii) Not covered by spliced ESTs; and
(iv) Alignment to the genome ends in proximity of long poly-A stretch or starts in proximity of long poly-T stretch.

Only reliable regions were selected for further scoring. Unique sequence regions were considered reliable if:
(i) Aligned to the genome; and
(ii) Regions supported by more than 2 ESTs.

The Algorithm

Each unique sequence region divides the set of transcripts into 2 groups:
(i) Transcripts containing this region (group TA).
(ii) Transcripts not containing this region (group TB).

The set of EST clones of every cluster is divided into 3 groups:
(i) Supporting (originating from) transcripts of group TA (S1).
(ii) Supporting transcripts of group TB (S2).
(iii) Supporting transcripts from both groups (S3).

Library and clones number scores described above were given to S1 group.

Fisher Exact Test P-values were used to check if:
S1 is significantly enriched by cancer EST clones compared to S2; and
S1 is significantly enriched by cancer EST clones compared to cluster background (S1+S2+S3).

Figure 2:
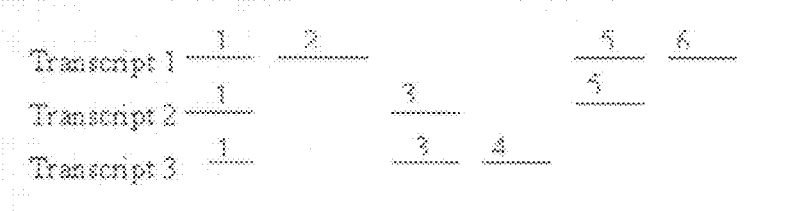
FIG. 2 is a schematic illustration, depicting grouping of transcripts of a given cluster based on presence or absence of unique sequence regions.

Identification of unique sequence regions and division of the group of transcripts accordingly is illustrated in FIG. 2. Each of these unique sequence regions corresponds to a segment, also termed herein a "node".

Region 1: common to all transcripts, thus it is not considered; Region 2: specific to Transcript 1: T_1 unique regions (2+6) against T_2+3 unique regions (3+4); Region 3: specific to Transcripts 2+3: T_2+3 unique regions (3+4) against T1 unique regions (2+6); Region 4: specific to Transcript 3: T_3 unique regions (4) against T1+2 unique regions (2+5+6); Region 5: specific to Transcript 1+2: T_1+2 unique regions (2+5+6) against T3 unique regions (4); Region 6: specific to Transcript 1: same as region 2.

Example 5

Identification of Cancer Specific Splice Variants of Genes Over Expressed in Cancer A search for EST supported (no mRNA) regions for genes of:
(i) known cancer markers
(ii) Genes shown to be over-expressed in cancer in published micro-array experiments.

Reliable EST supported-regions were defined as supported by minimum of one of the following:
(i) 3 spliced ESTs; or
(ii) 2 spliced ESTs from 2 libraries;
(iii) 10 unspliced ESTs from 2 libraries, or
(iv) 3 libraries.

Actual Marker Examples

The following examples relate to specific actual marker examples.

EXPERIMENTAL EXAMPLES SECTION

This Section relates to Examples describing experiments involving these sequences, and illustrative, non-limiting examples of methods, assays and uses thereof. The materials and experimental procedures are explained first, as all experiments used them as a basis for the work that was performed.

The markers of the present invention were tested with regard to their expression in various cancerous and non-cancerous tissue samples. A description of the samples used in the panel is provided in Table 2 below. A description of the samples used in the normal tissue panel is provided in Table 3 below. Tests were then performed as described in the "Materials and Experimental Procedures" section below.

TABLE 2

Tissue samples in testing panel

| | Lot No. | Pathology | Sex/Age | Source |
|---|---|---|---|---|
| 66-A-Adeno G1 GS-4 | 160202 | Adenocarcinoma Gleason score 4 | M/64 | ABS |
| 73-A-Adeno G1 GS-4 | 16026T2 | Acinar Adenocarcinoma Gleason score 4(2 + 2) | M/77 | ABS |
| 68-A-Adeno G1 GS-5 | 160172 | Adenocarcinoma Gleason score 5 | M/66 | ABS |
| 56-Am-Adeno G1 GS-5 | 36467 | Adenocarcinoma, Gleason score 5(3 + 2); stage 2 | M/72 | Ambion |
| 58-Am-Adeno G1 GS-5 | 37192 | Adenocarcinoma, Gleason score 5; stage 2 | M/52 | Ambion |
| 65-A-Adeno G2 GS-5 | 160022 | Adenocarcinoma Gleason score 5; | M/66 | ABS |
| 69-A-Adeno GS-5 | 160182 | Acinar Adenocarcinoma Gleason score 5 | M/58 | ABS |
| 55-Am-Adeno GS-5 | 36464 | Adenocarcinoma, Gleason score 5; stage 1 | M/53 | Ambion |
| 64-A-Adeno G2 GS-6 | 160092 | Acinar Adenocarcinoma Gleason score 6 | M/71 | ABS |
| 70-A-Adeno G2 GS-6 | 160192 | Adenocarcinoma Gleason score 6 | M/53 | ABS |
| 18-A-Adeno GS-6 | 5610020069T | Adenocarcinoma, Gleason score 6 (3 + 3) | M | ABS |
| 67-A-Adeno GS-6 | 160142 | Acinar Adenocarcinoma Gleason score 6 | M/62 | ABS |
| 25-A-Adeno GS-7 | 5605020052T | Adenocarcinoma, Gleason score 7 (4 + 3) | M | ABS |
| 26-A-Adeno GS-7 | 5609020067T | Adenocarcinoma, Gleason score 7 (4 + 3) | M | ABS |
| 72-A-Adeno GS-7 | 160122 | Acinar Adenocarcinoma Gleason score 7 | M/66 | ABS |

TABLE 2-continued

Tissue samples in testing panel

|  | Lot No. | Pathology | Sex/Age | Source |
|---|---|---|---|---|
| 71-A-Adeno GS-7 | 160242 | Acinar Adenocarcinoma Gleason score 7 | M/70 | ABS |
| 57-Am-Adeno GS-7 | 26442 | Adenocarcinoma, Gleason score 7 | M/62 | Ambion |
| 32-A-Adeno GS-9 | 5604020042T | Adenocarcinoma, Gleason score 9 (5 + 4) | M | ABS |
| 54-B-Adeno G3 | A610031 | Adenocarcinoma |  | Biochain |
| 33-A-BPH | 5607020058 | BPH | M | ABS |
| 34-A-BPH | 5607020059 | BPH | M | ABS |
| 35-A-BPH | 5607020060 | BPH | M | ABS |
| 43-B-PBH | A609267 | BPH | M/66 | Biochain |
| 44-B-PBH | A609268 | BPH | M/72 | Biochain |
| 45-B-PBH | A609269 | BPH | M/69 | Biochain |
| 46-B-PBH | A609270 | BPH | M/65 | Biochain |
| 47-B-PBH | A609271 | BPH | M/71 | Biochain |
| 40-A-N M26 | 5609020067N | Normal Matched | M | ABS |
| 41-A-N M32 | 5604020042N | Normal Matched | M | ABS |
| 48-B-N | A609257 | Normal PM | M/24 | Biochain |
| 49-B-N | A609256 | Normal PM | M/36 | Biochain |
| 50-B-N | A609255 | Normal PM | M/26 | Biochain |
| 51-B-N | A609258 | Normal PM | M/27 | Biochain |
| 52-B-N | A609254 | Normal PM | M/29 | Biochain |
| 53-Cl-N | 1070317 | Normal - Pool of 47 | M&F | Clontech |
| 42-Am-N | 061P04A | Normal (IC BLEED) | M/47 | ambion |
| 59-Am-N | 25955 | Normal PM (Head trauma) | M/62 | Ambion |
| 60-Am-N | 33605 | Normal PM (Myocardial infraction) | M/69 | Ambion |
| 61-Am-N | 34077 | Normal PM (Alzheimer's) | M/71 | Ambion |
| 62-Am-N | 31316 | Normal (Renal failure) | M/79 | Ambion |
| 63-Am-N | 30991 | Normal (Gall Bladder cancer) | M/78 | Ambion |

TABLE 3

Tissue samples in normal panel:

|  | Lot no. | Source | Tissue | Pathology | Sex/Age |
|---|---|---|---|---|---|
| 1-Am-Colon (C71) | 071P10B | Ambion | Colon | PM | F/43 |
| 2-B-Colon (C69) | A411078 | Biochain | Colon | PM-Pool of 10 | M & F |
| 3-Cl-Colon (C70) | 1110101 | Clontech | Colon | PM-Pool of 3 | M & F |
| 4-Am-Small Intestine | 091P0201A | Ambion | Small Intestine | PM | M/75 |
| 5-B-Small Intestine | A501158 | Biochain | Small Intestine | PM | M/63 |
| 6-B-Rectum | A605138 | Biochain | Rectum | PM | M/25 |
| 7-B-Rectum | A610297 | Biochain | Rectum | PM | M/24 |
| 8-B-Rectum | A610298 | Biochain | Rectum | PM | M/27 |
| 9-Am-Stomach | 110P04A | Ambion | Stomach | PM | M/16 |
| 10-B-Stomach | A501159 | Biochain | Stomach | PM | M/24 |
| 11-B-Esophagus | A603814 | Biochain | Esophagus | PM | M/26 |
| 12-B-Esophagus | A603813 | Biochain | Esophagus | PM | M/41 |
| 13-Am-Pancreas | 071P25C | Ambion | Pancreas | PM | M/25 |
| 14-CG-Pancreas | CG-255-2 | Ichilov | Pancreas | PM | M/75 |
| 15-B-Lung | A409363 | Biochain | Lung | PM | F/26 |
| 16-Am-Lung (L93) | 111P0103A | Ambion | Lung | PM | F/61 |
| 17-B-Lung (L92) | A503204 | Biochain | Lung | PM | M/28 |
| 18-Am-Ovary (O47) | 061P43A | Ambion | Ovary | PM | F/16 |
| 19-B-Ovary (O48) | A504087 | Biochain | Ovary | PM | F/51 |
| 20-B-Ovary (O46) | A504086 | Biochain | Ovary | PM | F/41 |
| 21-Am-Cervix | 101P0101A | Ambion | Cervix | PM | F/40 |
| 22-B-Cervix | A408211 | Biochain | Cervix | PM | F/36 |
| 23-B-Cervix | A504089 | Biochain | Cervix | PM-Pool of 5 | M & F |
| 24-B-Uterus | A411074 | Biochain | Uterus | PM-Pool of 10 | M & F |
| 25-B-Uterus | A409248 | Biochain | Uterus | PM | F/43 |
| 26-B-Uterus | A504090 | Biochain | Uterus | PM-Pool of 5 | M & F |
| 27-B-Bladder | A501157 | Biochain | Bladder | PM | M/29 |
| 28-Am-Bladder | 071P02C | Ambion | Bladder | PM | M/20 |
| 29-B-Bladder | A504088 | Biochain | Bladder | PM-Pool of 5 | M & F |
| 30-Am-Placenta | 021P33A | Ambion | Placenta | PB | F/33 |
| 31-B-Placenta | A410165 | Biochain | Placenta | PB | F/26 |
| 32-B-Placenta | A411073 | Biochain | Placenta | PB-Pool of 5 | M & F |
| 33-B-Breast (B59) | A607155 | Biochain | Breast | PM | F/36 |
| 34-Am-Breast (B63) | 26486 | Ambion | Breast | PM | F/43 |
| 35-Am-Breast (B64) | 23036 | Ambion | Breast | PM | F/57 |
| 36-Cl-Prostate (P53) | 1070317 | Clontech | Prostate | PB-Pool of 47 | M & F |
| 37-Am-Prostate (P42) | 061P04A | Ambion | Prostate | PM | M/47 |
| 38-Am-Prostate (P59) | 25955 | Ambion | Prostate | PM | M/62 |
| 39-Am-Testis | 111P0104A | Ambion | Testis | PM | M/25 |

TABLE 3-continued

Tissue samples in normal panel:

| | Lot no. | Source | Tissue | Pathology | Sex/Age |
|---|---|---|---|---|---|
| 40-B-Testis | A411147 | Biochain | Testis | PM | M/74 |
| 41-Cl-Testis | 1110320 | Clontech | Testis | PB-Pool of 45 | M & F |
| 42-CG-Adrenal | CG-184-10 | Ichilov | Adrenal | PM | F/81 |
| 43-B-Adrenal | A610374 | Biochain | Adrenal | PM | F/83 |
| 44-B-Heart | A411077 | Biochain | Heart | PB-Pool of 5 | M & F |
| 45-CG-Heart | CG-255-9 | Ichilov | Heart | PM | M/75 |
| 46-CG-Heart | CG-227-1 | Ichilov | Heart | PM | F/36 |
| 47-Am-Liver | 081P0101A | Ambion | Liver | PM | M/64 |
| 48-CG-Liver | CG-93-3 | Ichilov | Liver | PM | F/19 |
| 49-CG-Liver | CG-124-4 | Ichilov | Liver | PM | F/34 |
| 50-Cl-BM | 1110932 | Clontech | Bone Marrow | PM-Pool of 8 | M & F |
| 51-CGEN-Blood | WBC#5 | CGEN | Blood | | M |
| 52-CGEN-Blood | WBC#4 | CGEN | Blood | | M |
| 53-CGEN-Blood | WBC#3 | CGEN | Blood | | M |
| 54-CG-Spleen | CG-267 | Ichilov | Spleen | PM | F/25 |
| 55-CG-Spleen | 111P0106B | Ambion | Spleen | PM | M/25 |
| 56-CG-Spleen | A409246 | Biochain | Spleen | PM | F/12 |
| 56-CG-Thymus | CG-98-7 | Ichilov | Thymus | PM | F/28 |
| 58-Am-Thymus | 101P0101A | Ambion | Thymus | PM | M/14 |
| 59-B-Thymus | A409278 | Biochain | Thymus | PM | M/28 |
| 60-B-Thyroid | A610287 | Biochain | Thyroid | PM | M/27 |
| 61-B-Thyroid | A610286 | Biochain | Thyroid | PM | M/24 |
| 62-CG-Thyroid | CG-119-2 | Ichilov | Thyroid | PM | F/66 |
| 63-Cl-Salivary Gland | 1070319 | Clontech | Salivary Gland | PM-Pool of 24 | M & F |
| 64-Am-Kidney | 111P0101B | Ambion | Kidney | PM-Pool of 14 | M & F |
| 65-Cl-Kidney | 1110970 | Clontech | Kidney | PM-Pool of 14 | M & F |
| 66-B-Kidney | A411080 | Biochain | Kidney | PM-Pool of 5 | M & F |
| 67-CG-Cerebellum | CG-183-5 | Ichilov | Cerebellum | PM | M/74 |
| 68-CG-Cerebellum | CG-212-5 | Ichilov | Cerebellum | PM | M/54 |
| 69-B-Brain | A411322 | Biochain | Brain | PM | M/28 |
| 70-Cl-Brain | 1120022 | Clontech | Brain | PM-Pool of 2 | M & F |
| 71-B-Brain | A411079 | Biochain | Brain | PM-Pool of 2 | M & F |
| 72-CG-Brain | CG-151-1 | Ichilov | Brain | PM | F/86 |
| 73-Am-Skeletal Muscle | 101P013A | Ambion | Skeletal Muscle | PM | F/28 |
| 74-Cl-Skeletal Muscle | 1061038 | Clontech | Skeletal Muscle | PM-Pool of 2 | M & F |

Materials and Experimental Procedures

RNA preparation—RNA was obtained from Clontech (Franklin Lakes, N.J. USA 07417, clontech dot com), Bio-Chain Inst. Inc. (Hayward, Calif. 94545 USA biochain dot com), ABS (Wilmington, Del. 19801, USA, absbioreagents dot com) or Ambion (Austin, Tex. 78744 USA, ambion dot com). Alternatively, RNA was generated from tissue samples using TRi-Reagent (Molecular Research Center), according to Manufacturer's instructions. Tissue and RNA samples were obtained from patients or from postmortem. Total RNA samples were treated with DNaseI (Ambion) and purified using RNeasy columns (Qiagen).

RT PCR—Purified RNA (1 μg) was mixed with 150 ng Random Hexamer primers (Invitrogen) and 500 μM dNTP in a total volume of 15.6 μl. The mixture was incubated for 5 min at 65° C. and then quickly chilled on ice. Thereafter, 5 μl of 5×SuperscriptII first strand buffer (Invitrogen), 2.4 μl 0.1M DTT and 40 units RNasin (Promega) were added, and the mixture was incubated for 10 min at 25° C., followed by further incubation at 42° C. for 2 min. Then, 1 μl (200units) of SuperscriptII (Invitrogen) was added and the reaction (final volume of 25 μl) was incubated for 50 min at 42° C. and then inactivated at 70° C. for 15 min. The resulting cDNA was diluted 1:20 in TE buffer (10 mM Tris pH=8, 1 mM EDTA pH=8).

Figure 3:
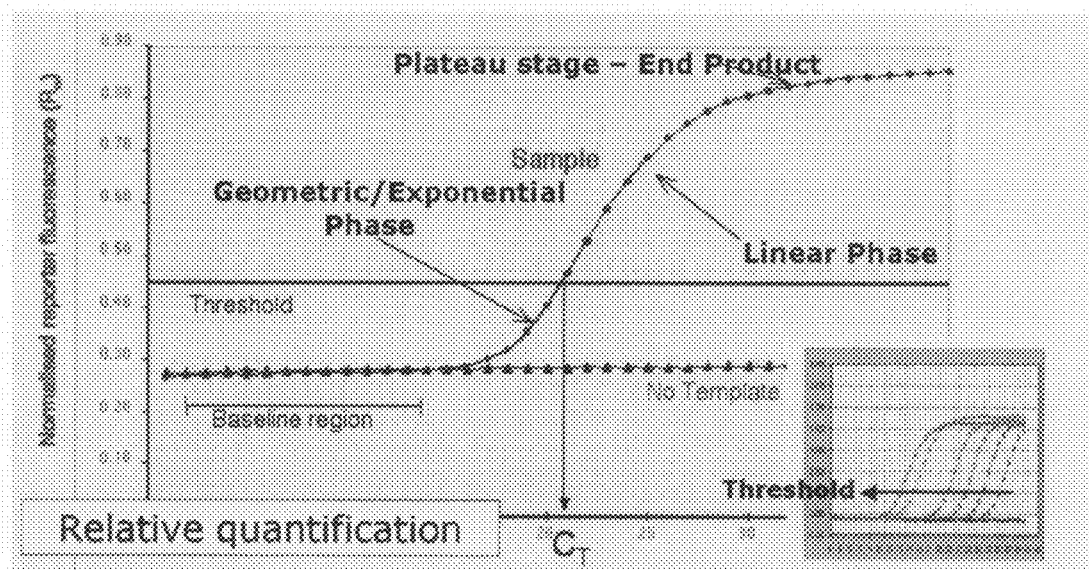
FIG. 3 is a schematic summary of quantitative real-time PCR analysis.

Real-Time RT-PCR analysis—cDNA (5μl), prepared as described above, was used as a template in Real-Time PCR reactions using the SYBR Green I assay (PE Applied Biosystem) with specific primers and UNG Enzyme (Eurogentech or ABI or Roche). The amplification was effected as follows: 50° C. for 2 min, 95° C. for 10 min, and then 40 cycles of 95° C. for 15 sec, followed by 60° C. for 1 min. Detection was performed by using the PE Applied Biosystem SDS 7000. The cycle in which the reactions achieved a threshold level (Ct) of fluorescence was registered and was used to calculate the relative transcript quantity in the RT reactions. The relative quantity was calculated using the equation $Q = efficiency^{-Ct}$. The efficiency of the PCR reaction was calculated from a standard curve, created by using serial dilutions of several reverse transcription (RT) reactions. To minimize inherent differences in the RT reaction, the resulting relative quantities were normalized to the geometric mean of the relative quantities of several housekeeping (HSKP) genes. Schematic summary of quantitative real-time PCR analysis is presented in FIG. 3. As shown, the x-axis shows the cycle number. The $C_T$=Threshold Cycle point, which is the cycle that the amplification curve crosses the fluorescence threshold that was set in the experiment. This point is a calculated cycle number in which PCR product signal is above the background level (passive dye ROX) and still in the Geometric/Exponential phase (as shown, once the level of fluorescence crosses the measurement threshold, it has a geometrically increasing phase, during which measurements are most accurate, followed by a linear phase and a plateau phase; for quantitative measurements, the latter two phases do not provide accurate measurements). The y-axis shows the normalized reporter fluorescence. It should be noted that this type of analysis provides relative quantification.

The sequences of the housekeeping genes measured in all the examples below on prostate panel were as follows:

SDHA (GenBank Accession No. NM_004168 (SEQ ID NO:508))

SDHA Forward primer (SEQ ID NO:405): TGGGAACAAGAGGGCATCTG

SDHA Reverse primer (SEQ ID NO:406): CCACCACTGCATCAAATTCATG

SDHA-amplicon (SEQ ID NO:407):
TGGGAACAAGAGGGCATCTGCTAAAGTTTCAGATTCCATTTCTGCTCAGTATCCAGTAGTGGATC

ATGAATTTGATGCAGTGGTGG

PBGD (GenBank Accession No. BC019323 (SEQ ID NO:509)),

PBGD Forward primer (SEQ ID NO:402): TGAGAGTGATTCGCGTGGG

PBGD Reverse primer (SEQ ID NO:403): CCAGGGTACGAGGCTTTCAAT

PBGD-amplicon (SEQ ID NO:404):
TGAGAGTGATTCGCGTGGGTACCCGCAAGAGCCAGCTTGCTCGCATACAGACGGACAGTGTGGTG

GCAACATTGAAAGCCTCGTACCCTGG

HPRT1 (GenBank Accession No. NM_000194 (SEQ ID NO:510)),

HPRT1 Forward primer (SEQ ID NO:399): TGACACTGGCAAAACAATGCA

HPRT1 Reverse primer (SEQ ID NO:400): GGTCCTTTTCACCAGCAAGCT

HPRT1-amplicon (SEQ ID NO:401):
TGACACTGGCAAAACAATGCAGACTTTGCTTTCCTTGGTCAGGCAGTATAATCCAAAGATGGTCA

AGGTCGCAAGCTTGCTGGTGAAAAGGACC

RPL19 (GenBank Accession No. NM_000981 (SEQ ID NO:511)

RPL19 Forward primer (SEQ ID NO:408): TGGCAAGAAGAAGGTCTGGTTAG

RPL19 Reverse primer (SEQ ID NO:409): TGATCAGCCCATCTTTGATGAG

RPL19-amplicon (SEQ ID NO:410):
TGGCAAGAAGAAGGTCTGGTTAGACCCCAATGAGACCAATGAAATCGCCAATGCCAACTCCCGTC

AGCAGATCCGGAAGCTCATCAAAGATGGGCTGATCA

The sequences of the housekeeping genes measured in all the examples on normal tissue samples panel were as follows:

RPL19 (GenBank Accession No. NM_000981 (SEQ ID NO:511)),

RPL19 Forward primer (SEQ ID NO:408): TGGCAAGAAGAAGGTCTGGTTAG

RPL19 Reverse primer (SEQ ID NO:409): TGATCAGCCCATCTTTGATGAG

RPL19-amplicon (SEQ ID NO:410):
TGGCAAGAAGAAGGTCTGGTTAGACCCCAATGAGACCAATGAAATCGCCAATGCCAACTCCCGTC

AGCAGATCCGGAAGCTCATCAAAGATGGGCTGATCA

TATA box (GenBank Accession No. NM_003194 (SEQ ID NO:512)),

TATA box Forward primer (SEQ ID NO:513): CGGTTTGCTGCGGTAATCAT

TATA box Reverse primer (SEQ ID NO:514): TTTCTTGCTGCCAGTCTGGAC

TATA box-amplicon (SEQ ID NO:515):
CGGTTTGCTGCGGTAATCATGAGGATAAGAGAGCCACGAACCACGGCACTGATTTTCAGTTCTGGGAAAAT

GGTGTGCACAGGAGCCAAGAGTGAAGAACAGTCCAGACTGGCAGCAAGAAA

-continued

UBC (GenBank Accession No. BC000449 (SEQ ID NO:516))

UBC Forward primer (SEQ ID NO:517): ATTTGGGTCGCGGTTCTTG

UBC Reverse primer (SEQ ID NO:518): TGCCTTGACATTCTCGATGGT

UBC-amplicon (SEQ ID NO:519):
ATTTGGGTCGCGGTTCTTGTTTGTGGATCGCTGTGATCGTCACTTGACAATGCAGATCTTCGTGAAGACTC

TGACTGGTAAGACCATCACCCTCGAGGTTGAGCCCAGTGACACCATCGAGAATGTCAAGGCA

SDHA (GenBank Accession No. NM_004168 (SEQ ID NO:508))

SDHA Forward primer (SEQ ID NO:405): TGGGAACAAGAGGGCATCTG

SDHA Reverse primer (SEQ ID NO:406): CCACCACTGCATCAAATTCATG

SDHA-amplicon (SEQ ID NO:407):
TGGGAACAAGAGGGCATCTGCTAAAGTTTCAGATTCCATTTCTGCTCAGTATCCAGTAGTGGATCATGAAT

TTGATGCAGTGGTGG

Oligonucleotide-Based Micro-Array Experiment Protocol—

Microarray Fabrication

Microarrays (chips) were printed by pin deposition using the MicroGrid II MGII 600 robot from BioRobtics Limited (Cambridge, UK). 50-mer oligonucleotides target sequences were designed by Compugen Ltd (Tel-Aviv, IL) as described by A. Shoshan et al, "Optical technologies and informatics", Proceedings of SPIE. Vol 4266, pp. 86-95 (2001). The designed oligonucleotides were synthesized and purified by desalting with the Sigma-Genosys system (The Woodlands, Tex., US) and all of the oligonucleotides were joined to a C6 amino-modified linker at the 5' end, or being attached directly to CodeLink slides (Cat #25-6700-01. Amersham Bioscience, Piscataway, N.J., US). The 50-mer oligonucleotides, forming the target sequences, were first suspended in Ultra-pure DDW (Cat # 01-866-1A Kibbutz Beit-Haemek, Israel) to a concentration of 50 µM. Before printing the slides, the oligonucleotides were resuspended in 300 mM sodium phosphate (pH 8.5) to final concentration of 150 mM and printed at 35-40% relative humidity at 21° C.

Each slide contained a total of 9792 features in 32 subarrays. Of these features, 4224 features were sequences of interest according to the present invention and negative controls that were printed in duplicate. An additional 288 features (96 target sequences printed in triplicate) contained housekeeping genes from Human Evaluation Library2, Compugen Ltd, Israel. Another 384 features are E. coli spikes 1-6, which are oligos to E-Coli genes which are commercially available in the Array Control product (Array control—sense oligo spots, Ambion Inc. Austin, Tex. Cat # 1781, Lot #112K06).

Post-Coupling Processing of Printed Slides

After the spotting of the oligonucleotides to the glass (CodeLink) slides, the slides were incubated for 24 hours in a sealed saturated NaCl humidification chamber (relative humidity 70-75%).

Slides were treated for blocking of the residual reactive groups by incubating them in blocking solution at 50° C. for 15 minutes (10 ml/slide of buffer containing 0.1M Tris, 50 mM ethanolamine, 0.1% SDS). The slides were then rinsed twice with Ultra-pure DDW (double distilled water). The slides were then washed with wash solution (10 ml/slide. 4×SSC, 0.1% SDS)) at 50° C. for 30 minutes on the shaker. The slides were then rinsed twice with Ultra-pure DDW, followed by drying by centrifugation for 3 minutes at 800 rpm.

Next, in order to assist in automatic operation of the hybridization protocol, the slides were treated with Ventana Discovery hybridization station barcode adhesives. The printed slides were loaded on a Bio-Optica (Milan, Italy) hematology staining device and were incubated for 10 minutes in 50 ml of 3-Aminopropyl Triethoxysilane (Sigma A3648 lot #122K589). Excess fluid was dried and slides were then incubated for three hours in 20 mm/Hg in a dark vacuum desiccator (Pelco 2251, Ted Pella, Inc. Redding Calif.).

The following protocol was then followed with the Genisphere 900-RP (random primer), with mini elute columns on the Ventana Discovery HybStation™, to perform the microarray experiments. Briefly, the protocol was performed as described with regard to the instructions and information provided with the device itself. The protocol included cDNA synthesis and labeling. cDNA concentration was measured with the TBS-380 (Turner Biosystems. Sunnyvale, Calif.) PicoFlour, which is used with the OliGreen ssDNA Quantitation reagent and kit.

Hybridization was performed with the Ventana Hybridization device, according to the provided protocols (Discovery Hybridization Station Tuscon Ariz.).

The slides were then scanned with GenePix 4000B dual laser scanner from Axon Instruments Inc, and analyzed by GenePix Pro 5.0 software.

Figure 4:
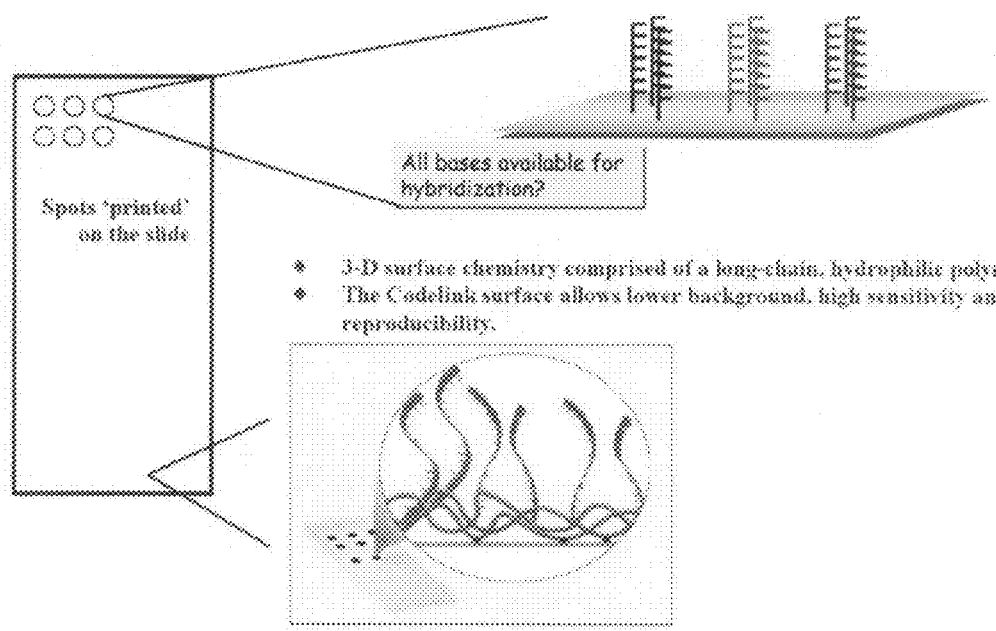
FIG. 4 is a schematic presentation of the oligonucleotide based microarray fabrication.
Figure 5:
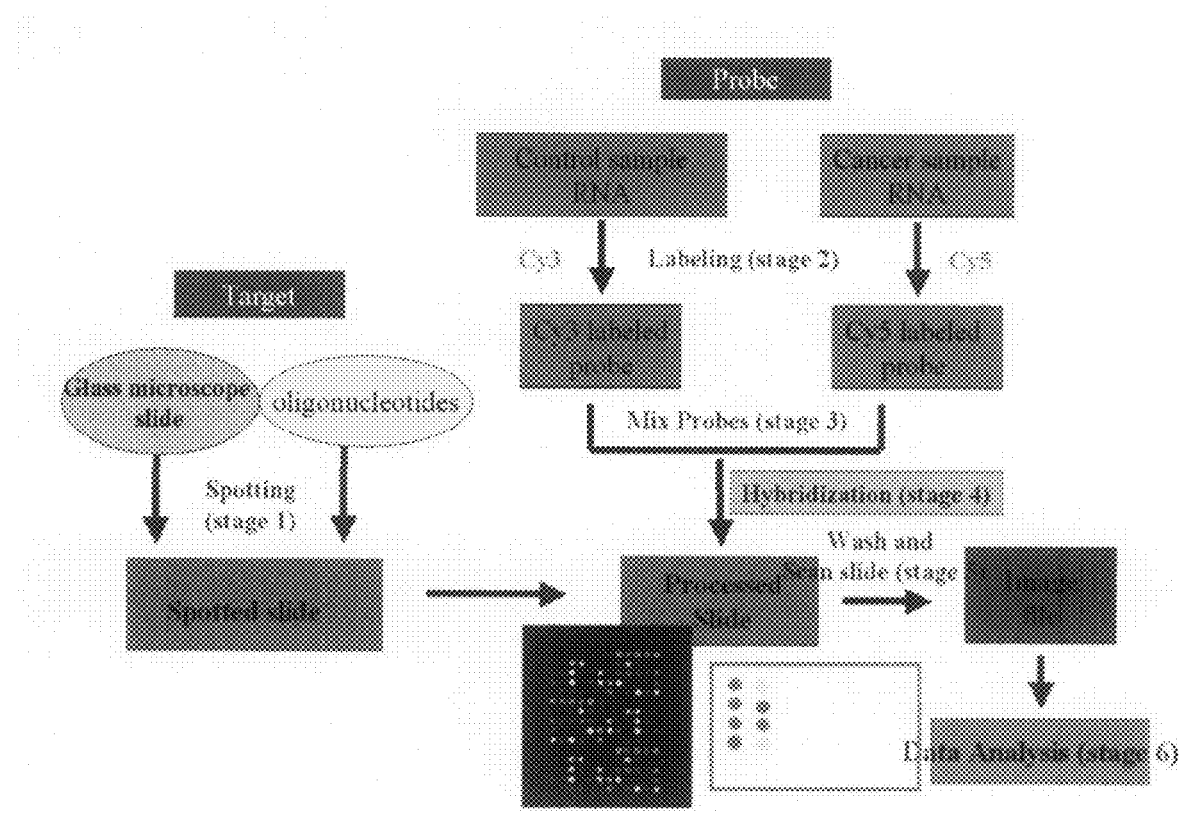
FIG. 5 is a schematic summary of the oligonucleotide based microarray experimental flow.

Schematic summary of the oligonucleotide based microarray fabrication and the experimental flow is presented in FIGS. 4 and 5.

Briefly, as shown in FIG. 4, DNA oligonucleotides at 25 uM were deposited (printed) onto Amersham 'CodeLink' glass slides generating a well defined 'spot'. These slides are covered with a long-chain, hydrophilic polymer chemistry that creates an active 3-D surface that covalently binds the DNA oligonucleotides 5'-end via the C6-amine modification. This binding ensures that the full length of the DNA oligonucleotides is available for hybridization to the cDNA and also allows lower background, high sensitivity and reproducibility.

FIG. 5 shows a schematic method for performing the microarray experiments. It should be noted that stages on the left-hand or right-hand side may optionally be performed in any order, including in parallel, until stage 4 (hybridization).

Briefly, on the left-hand side, the target oligonucleotides are being spotted on a glass microscope slide (although optionally other materials could be used) to form a spotted slide (stage 1). On the right hand side, control sample RNA and cancer sample RNA are Cy3 and Cy5 labeled, respectively (stage 2), to form labeled probes. It should be noted that the control and cancer samples come from corresponding tissues (for example, normal prostate tissue and cancerous prostate tissue). Furthermore, the tissue from which the RNA was taken is indicated below in the specific examples of data for particular clusters, with regard to overexpression of an oligonucleotide from a "chip" (microarray), as for example "prostate" for chips in which prostate cancerous tissue and normal tissue were tested as described above. In stage 3, the probes are mixed. In stage 4, hybridization is performed to form a processed slide. In stage 5, the slide is washed and scanned to form an image file, followed by data analysis in stage 6.

Description for Cluster HSECADH

Cluster HSECADH features 4 transcript(s) and 30 segment(s) of interest, the names for which are given in Tables 4 and 5, respectively, the sequences themselves are given at the end of the application. The selected protein variants are given in table 6.

TABLE 4

Transcripts of interest

| Transcript Name | Sequence ID No. |
|---|---|
| HSECADH_T11 | 1 |
| HSECADH_T18 | 2 |
| HSECADH_T19 | 3 |
| HSECADH_T20 | 4 |

TABLE 5

Segments of interest

| Segment Name | Sequence ID No. |
|---|---|
| HSECADH_node_0 | 60 |
| HSECADH_node_14 | 61 |
| HSECADH_node_15 | 62 |
| HSECADH_node_21 | 63 |
| HSECADH_node_22 | 64 |
| HSECADH_node_25 | 65 |
| HSECADH_node_26 | 66 |
| HSECADH_node_48 | 67 |
| HSECADH_node_52 | 68 |
| HSECADH_node_53 | 69 |
| HSECADH_node_54 | 70 |
| HSECADH_node_57 | 71 |

TABLE 5-continued

Segments of interest

| Segment Name | Sequence ID No. |
|---|---|
| HSECADH_node_60 | 72 |
| HSECADH_node_62 | 73 |
| HSECADH_node_63 | 74 |
| HSECADH_node_7 | 75 |
| HSECADH_node_1 | 76 |
| HSECADH_node_11 | 77 |
| HSECADH_node_12 | 78 |
| HSECADH_node_17 | 79 |
| HSECADH_node_18 | 80 |
| HSECADH_node_19 | 81 |
| HSECADH_node_3 | 82 |
| HSECADH_node_42 | 83 |
| HSECADH_node_45 | 84 |
| HSECADH_node_46 | 85 |
| HSECADH_node_55 | 86 |
| HSECADH_node_56 | 87 |
| HSECADH_node_58 | 88 |
| HSECADH_node_59 | 89 |

TABLE 6

Proteins of interest

| Protein Name | Sequence ID No. |
|---|---|
| HSECADH_P9 | 327 |
| HSECADH_P13 | 328 |
| HSECADH_P14 | 329 |
| HSECADH_P15 | 330 |

These sequences are variants of the known protein Epithelial-cadherin precursor (SEQ ID NO:384) (SwissProt accession identifier CAD1_HUMAN (SEQ ID NO: 384); known also according to the synonyms E-cadherin; Uvomorulin; Cadherin-1; CAM 120/80), SEQ ID NO: 384, referred to herein as the previously known protein.

The variant proteins according to the present invention are variants of a known diagnostic marker, called E-Cadherin.

Protein Epithelial-cadherin is known or believed to have the following function(s): Cadherins are calcium dependent cell adhesion proteins. They preferentially interact with themselves in a homophilic manner in connecting cells; cadherins may thus contribute to the sorting of heterogeneous cell types. E-cadherin has a potent invasive suppressor role. It is also a ligand for integrin alpha-E/beta-7. The sequence for protein Epithelial-cadherin precursor (SEQ ID NO:384) is given at the end of the application, as "Epithelial-cadherin precursor (SEQ ID NO:384) amino acid sequence". Known polymorphisms for this sequence are as shown in Table 7.

TABLE 7

Amino acid mutations for Known Protein

| SNP position(s) on amino acid sequence | Comment |
|---|---|
| 123 | H -> Y (in diffuse gastric cancer). /FTId = VAR_001306. |
| 193 | T -> P (in diffuse gastric cancer). /FTId = VAR_001307. |
| 418-423 | Missing (in gastric carcinoma). /FTId = VAR_001313. |
| 463 | E -> Q (in diffuse gastric cancer). /FTId = VAR_001314. |
| 470 | T -> I. /FTId = VAR_001315. |
| 473 | V -> D (in diffuse gastric cancer). /FTId = VAR_001317. |
| 487 | V -> A (in HDGC). /FTId = VAR_008713. |

TABLE 7-continued

Amino acid mutations for Known Protein

SNP position(s) on
amino acid sequence    Comment

| | |
|---|---|
| 592 | A -> T (in thyroid cancer; may play a role in colorectal carcinogenesis). /FTId = VAR_001318. |
| 598 | R -> Q (in diffuse gastric cancer). /FTId = VAR_001319. |
| 617 | A -> T (in endometrial cancer; loss of heterozygosity). /FTId = VAR_001320. |
| 711 | L -> V (in endometrial cancer). /FTId = VAR_001321. |
| 838 | S -> G (in ovarian cancer; loss of heterozygosity). /FTId = VAR_001322. |
| 244 | D -> G (in HDGC). /FTId = VAR_008712. |
| 10 | A -> G |
| 16-51 | QVSSWLCQEPEPCHPGFDAESYTFTVPRRHLERGRV -> RSPLGSQERSPPPCLTRELHVHGAPAPPEKRPR |
| 68-75 | YFSLDTRF -> IFLTPIP |
| 95-102 | QIHFLVYA -> TDPFLGLR |
| 483 | A -> G |
| 530 | A -> R |
| 543 | S -> F |
| 615 | I -> H |
| 634-636 | ASA -> RVP |
| 868 | R -> P |
| 270 | S -> A (may contribute to prostate cancer). /FTId = VAR_013970. |
| 882 | D -> H |
| 274-277 | Missing (in gastric adenocarcinoma). /FTId = VAR_001308. |
| 315 | N -> S (in lobular breast carcinoma). /FTId = VAR_001309. |
| 336 | E -> D. /FTId = VAR_001310. |
| 340 | T -> A (in HDGC and colorectal cancer). /FTId = VAR_013971. |
| 370 | D -> A (in diffuse gastric cancer). /FTId = VAR_001311. |
| 400 | Missing (in gastric carcinoma; loss of heterozygosity). /FTId = VAR_001312. |

Protein Epithelial-cadherin localization is believed to be Type I membrane protein.

The following GO Annotation(s) apply to the previously known protein. The following annotation(s) were found: cell adhesion; homophilic cell adhesion, which are annotation(s) related to Biological Process; calcium binding; protein binding, which are annotation(s) related to Molecular Function; and membrane; integral membrane protein, which are annotation(s) related to Cellular Component.

The GO assignment relies on information from one or more of the SwissProt/TremB1 Protein knowledgebase, available from expasydot ch/sprot/; or Locuslink, available from ncbidot nlmdot nihdot gov/projects/LocusLink/.

Cluster HSECADH can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 6 refer to weighted expression of ESTs in each category, as "parts per million" (ratio of the expression of ESTs for a particular cluster to the expression of all ESTs in that category, according to parts per million).

Figure 6:
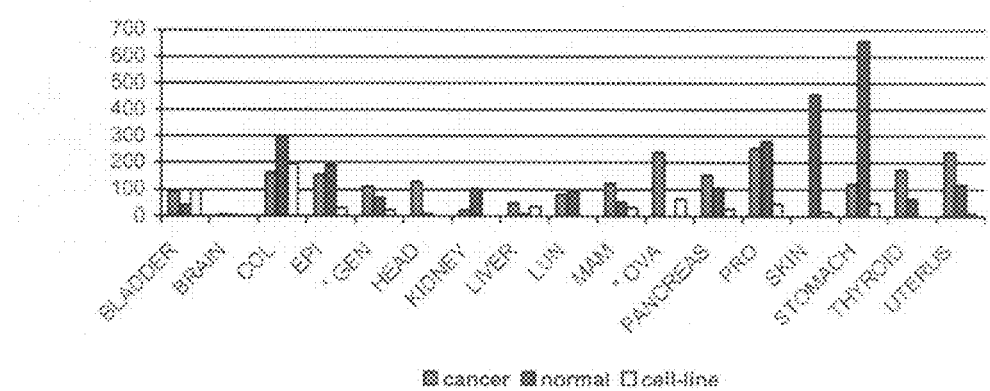
FIG. 6 is a histogram is a histogram showing Cancer and cell-line vs. normal tissue expression for Cluster HSECADH, demonstrating overexpression in a mixture of malignant tumors from different tissues and ovarian carcinoma.

Overall, the following results were obtained as shown with regard to the histograms in FIG. 6 and Table 8. This cluster is overexpressed (at least at a minimum level) in the following pathological conditions: a mixture of malignant tumors from different tissues and ovarian carcinoma.

TABLE 8

Normal tissue distribution

| Name of Tissue | Number |
|---|---|
| Bladder | 41 |
| Brain | 3 |
| Colon | 299 |
| Epithelial | 190 |
| General | 67 |
| head and neck | 10 |
| Kidney | 103 |
| Liver | 9 |
| Lung | 93 |
| Breast | 52 |
| Ovary | 0 |
| Pancreas | 105 |
| Prostate | 279 |
| Skin | 457 |
| Stomach | 659 |
| Thyroid | 64 |
| Uterus | 118 |

TABLE 9

P values and ratios for expression in cancerous tissue

| Name of Tissue | P1 | P2 | SP1 | R3 | SP2 | R4 |
|---|---|---|---|---|---|---|
| Bladder | 3.9e−01 | 3.4e−01 | 4.1e−01 | 1.7 | 3.8e−01 | 1.7 |
| Brain | 3.7e−01 | 4.9e−01 | 1 | 1.4 | 1 | 1.0 |
| Colon | 6.6e−01 | 7.4e−01 | 9.5e−01 | 0.6 | 9.3e−01 | 0.5 |
| Epithelial | 1.3e−01 | 6.8e−01 | 9.5e−01 | 0.8 | 1 | 0.5 |
| General | 1.6e−06 | 1.5e−03 | 6.3e−05 | 1.5 | 5.6e−01 | 0.9 |
| head and neck | 1.5e−01 | 2.7e−01 | 4.6e−01 | 2.1 | 7.5e−01 | 1.2 |
| Kidney | 8.3e−01 | 8.7e−01 | 9.9e−01 | 0.4 | 1 | 0.3 |

TABLE 9-continued

P values and ratios for expression in cancerous tissue

| Name of Tissue | P1 | P2 | SP1 | R3 | SP2 | R4 |
|---|---|---|---|---|---|---|
| Liver | 4.4e−01 | 6.9e−01 | 1 | 1.7 | 6.9e−01 | 1.5 |
| Lung | 7.2e−01 | 8.8e−01 | 7.5e−01 | 0.9 | 9.9e−01 | 0.4 |
| Breast | 7.5e−02 | 1.1e−01 | 3.1e−01 | 1.7 | 5.1e−01 | 1.2 |
| Ovary | 4.5e−02 | 3.6e−02 | 4.7e−03 | 3.8 | 1.4e−02 | 3.5 |
| Pancreas | 5.5e−01 | 6.5e−01 | 2.4e−01 | 0.9 | 5.2e−01 | 0.7 |
| Prostate | 8.1e−01 | 8.5e−01 | 6.4e−01 | 0.8 | 9.0e−01 | 0.6 |
| Skin | 5.7e−01 | 7.4e−01 | 1 | 0.0 | 1 | 0.1 |
| Stomach | 2.2e−01 | 5.2e−01 | 1 | 0.2 | 1 | 0.1 |
| Thyroid | 5.5e−01 | 5.5e−01 | 4.4e−01 | 1.6 | 4.4e−01 | 1.6 |
| Uterus | 5.0e−02 | 2.4e−01 | 1.0e−01 | 1.3 | 5.8e−01 | 0.8 |

As noted above, cluster HSECADH features 4 transcript(s), which were listed in Table 4 above. These transcript(s) encode for protein(s) which are variant(s) of protein Epithelial-cadherin precursor (SEQ ID NO:384). A description of each variant protein according to the present invention is now provided.

Variant protein HSECADH_P9 (SEQ ID NO:327) according to the present invention has an amino acid sequence as given at the end of the application; it is encoded by transcript(s) HSECADH_T11 (SEQ ID NO:1). An alignment is given to the known protein (Epithelial-cadherin precursor (SEQ ID NO:384)) at the end of the application. One or more alignments to one or more previously published protein sequences are given at the end of the application. A brief description of the relationship of the variant protein according to the present invention to each such aligned protein is as follows:

Comparison report between HSECADH_P9 (SEQ ID NO:327) and Q9UII7 (SEQ ID NO:483):

1. An isolated chimeric polypeptide encoding for HSEC-ADH_P9 (SEQ ID NO:327), comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDST YRKFSTKVTLNT VGHHHRPPPHQASVSGIQAELLTF-PNSSPGLRRQKRDWVIPPISCPENEKGPFPKNLVQI KSNKDKEGKVFYSITGQGADTP-PVGVFIIERETGWLKVTEPLDRERIATYTLFSHAVSSN GNAVEDPMEILITVTDQNDNKPEFTQEVFKGSVMEG corresponding to amino acids 1-274 of Q9UII7, which also corresponds to amino acids 1-274 of HSECADH_P9 (SEQ ID NO:327), and a second amino acid sequence being at least 70%, optionally at least 80%, preferably at least 85%, more preferably at least 90% and most preferably at least 95% homologous to a polypeptide having the sequence TACRSRIANSCHSGDSWRNSCFANSD-SAALAVSSEESGGQRALTAPRG (SEQ ID NO: 532) corresponding to amino acids 275-322 of HSECADH_P9 (SEQ ID NO:327), wherein said first and second amino acid sequences are contiguous and in a sequential order.

2. An isolated polypeptide encoding for a tail of HSEC-ADH_P9 (SEQ ID NO:327), comprising a polypeptide being at least 70%, optionally at least about 80%, preferably at least about 85%, more preferably at least about 90% and most preferably at least about 95% homologous to the sequence TACRSRIANSCHSGDSWRNSCFANSD-SAALAVSSEESGGQRALTAPRG (SEQ ID NO: 532) in HSECADH_P9 (SEQ ID NO:327).

Comparison report between HSECADH_P9 (SEQ ID NO:327) and Q9UII8 (SEQ ID NO:484):

1. An isolated chimeric polypeptide encoding for HSEC-ADH_P9 (SEQ ID NO:327) comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDS TYRKFSTKVTLNT VGHHHRPPPHQASVSGIQAELLT-FPNSSPGLRRQKRDWVIPPISCPENEKGPFPKNLVQI KSNKDKEGKVFYSITGQGADTP-PVGVFIIERETGWLKVTEPLDRERIATYTLFSHAVSSN GNAVEDPMEILITVTDQNDNKPEFTQEVFKGSVMEG corresponding to amino acids 1-274 of Q9UII8, which also corresponds to amino acids 1-274 of HSECADH_P9 (SEQ ID NO:327), and a second amino acid sequence being at least 70%, optionally at least 80%, preferably at least 85%, more preferably at least 90% and most preferably at least 95% homologous to a polypeptide having the sequence TACRSRIANSCHSGDSWRNSCFANSD-SAALAVSSEESGGQRALTAPRG (SEQ ID NO: 532) corresponding to amino acids 275-322 of HSECADH_P9 (SEQ ID NO:327), wherein said first and second amino acid sequences are contiguous and in a sequential order.

2. An isolated polypeptide encoding for a tail of HSEC-ADH_P9 (SEQ ID NO:327) comprising a polypeptide being at least 70%, optionally at least about 80%, preferably at least about 85%, more preferably at least about 90% and most preferably at least about 95% homologous to the sequence TACRSRIANSCHSGDSWRNSCFANSD-SAALAVSSEESGGQRALTAPRG (SEQ ID NO: 532) in HSECADH_P9 (SEQ ID NO:327).

Comparison report between HSECADH_P9 (SEQ ID NO:327) and CAD1_HUMAN:

1. An isolated chimeric polypeptide encoding for HSEC-ADH_P9 (SEQ ID NO:327) comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDS TYRKFSTKVTLNT VGHHHRPPPHQASVSGIQAELLT-FPNSSPGLRRQKRDWVIPPISCPENEKGPFPKNLVQI KSNKDKEGKVFYSITGQGADTP-PVGVFIIERETGWLKVTEPLDRERIATYTLFSHAVSSN GNAVEDPMEILITVTDQNDNKPEFTQEVFKGSVMEG corresponding to amino acids 1-274 of CAD1_HUMAN, which also corresponds to amino acids 1-274 of HSEC-ADH_P9 (SEQ ID NO:327), and a second amino acid sequence being at least 70%, optionally at least 80%, preferably at least 85%, more preferably at least 90% and most preferably at least 95% homologous to a polypeptide having the sequence TACRSRIANSCHSGDSWRNSC-FANSDSAALAVSSEESGGQRALTAPRG (SEQ ID NO: 532) corresponding to amino acids 275-322 of HSEC-ADH_P9 (SEQ ID NO:327), wherein said first and second amino acid sequences are contiguous and in a sequential order.

2. An isolated polypeptide encoding for a tail of HSEC-ADH_P9 (SEQ ID NO:327) comprising a polypeptide being at least 70%, optionally at least about 80%, preferably at least about 85%, more preferably at least about 90% and most preferably at least about 95% homologous to the sequence TACRSRIANSCHSGDSWRNSCFANSD-SAALAVSSEESGGQRALTAPRG (SEQ ID NO: 532) in HSECADH_P9 (SEQ ID NO:327).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSECADH_P9 (SEQ ID NO:327) also has the following non-silent SNPs (Single Nucleotide Polymorphisms) as listed in Table 10, (given according to their position(s) on the amino acid sequence, with the alternative amino acid(s) listed; the last column indicates whether the SNP is known or not; the presence of known SNPs in variant protein HSECADH_P9 (SEQ ID NO:327) sequence provides support for the deduced sequence of this variant protein according to the present invention).

TABLE 10

Amino acid mutations

| SNP position(s) on amino acid sequence | Alternative amino acid(s) | Previously known SNP? |
|---|---|---|
| 127 | P -> T | No |
| 141 | T -> A | No |
| 276 | A -> V | No |

Variant protein HSECADH_P9 (SEQ ID NO:327) is encoded by the following transcript(s): HSECADH_T11 (SEQ ID NO:1), for which the sequence(s) is/are given at the end of the application. The coding portion of transcript HSECADH_T11 (SEQ ID NO:1) is shown in bold; this coding portion starts at position 125 and ends at position 1090. The transcript also has the following SNPs as listed in Table 11 (given according to their position on the nucleotide sequence, with the alternative nucleic acid listed; the last column indicates whether the SNP is known or not; the presence of known SNPs in variant protein HSECADH_P9 (SEQ ID NO:327) sequence provides support for the deduced sequence of this variant protein according to the present invention).

TABLE 11

Nucleic acid SNPs

| SNP position on nucleotide sequence | Alternative nucleic acid | Previously known SNP? |
|---|---|---|
| 71 | G -> C | Yes |
| 469 | G -> A | Yes |
| 1487 | C -> T | Yes |
| 1556 | C -> A | Yes |
| 1556 | C -> G | Yes |
| 1556 | C -> T | Yes |
| 1603 | G -> A | Yes |
| 1604 | G -> A | Yes |
| 1688 | A -> G | Yes |
| 1712 | T -> | No |
| 1890 | T -> G | No |
| 1895 | T -> G | No |
| 503 | C -> A | No |
| 2090 | C -> T | Yes |
| 2621 | T -> A | Yes |
| 2621 | T -> C | Yes |
| 2621 | T -> G | Yes |
| 2797 | -> G | No |
| 2849 | G -> A | No |
| 2992 | A -> C | No |
| 3027 | C -> G | No |
| 3029 | C -> A | No |
| 3134 | T -> | No |
| 545 | A -> G | No |

TABLE 11-continued

Nucleic acid SNPs

| SNP position on nucleotide sequence | Alternative nucleic acid | Previously known SNP? |
|---|---|---|
| 3211 | T -> | No |
| 3258 | A -> G | No |
| 3336 | T -> C | Yes |
| 847 | A -> G | No |
| 951 | C -> T | No |
| 1331 | T -> C | No |
| 1377 | G -> A | No |
| 1487 | C -> A | Yes |
| 1487 | C -> G | Yes |

Variant protein HSECADH_P13 (SEQ ID NO:328) according to the present invention has an amino acid sequence as given at the end of the application; it is encoded by transcript(s) HSECADH_T18 (SEQ ID NO:2). An alignment is given to the known protein (Epithelial-cadherin precursor (SEQ ID NO:384) at the end of the application. One or more alignments to one or more previously published protein sequences are given at the end of the application. A brief description of the relationship of the variant protein according to the present invention to each such aligned protein is as follows:

Comparison report between HSECADH_P13 (SEQ ID NO:328) and Q9UII7:

1. An isolated chimeric polypeptide encoding for HSECADH_P13 (SEQ ID NO:328), comprising a first amino acid sequence being at least 90% homologous to MPGWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDS TYRKFSTKVTLNT VGHHHRPPPHQASVSGIQAELLT-FPNSSPGLRRQKRDWVIPPISCPENEKGPFPKNLVQI KSNKDKEGKVFYSITGQGADTP-PVGVFIIERETGWLKVTEPLDRERIATYTLFSHAVSSN GNAVEDPMEILITVTDQNDNK-PEFTQEVFKGSVMEGALPGTSVMEVTAT-DADDDVNT YNAAIAYTILSQDPELPDKNMFTINRN-TGVISVVTTGLDRESFPTYTLVVQAADLQGEGL STTATAVITVTDTNDNPPIFNPTT corresponding to amino acids 1-379 of Q9UII7, which also corresponds to amino acids 1-379 of HSECADH_P13 (SEQ ID NO:328), and a second amino acid sequence VIL corresponding to amino acids 380-382 of HSECADH_P13 (SEQ ID NO:328), wherein said first and second amino acid sequences are contiguous and in a sequential order.

Comparison report between HSECADH_P13 (SEQ ID NO:328) and Q9UII8:

1. An isolated chimeric polypeptide encoding for HSECADH_P13 (SEQ ID NO:328) comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDST YRKFSTKVTLNT VGHHHRPPPHQASVSGIQAELLTF-PNSSPGLRRQKRDWVIPPISCPENEKGPFPKNLVQI KSNKDKEGKVFYSITGQGADTP-PVGVFIIERETGWLKVTEPLDRERIATYTLFSHAVSSN GNAVEDPMEILITVTDQNDNK-PEFTQEVFKGSVMEGALPGTSVMEVTAT-DADDDVNT YNAAIAYTILSQDPELPDKNMFTINRN-TGVISVVTTGLDRESFPTYTLVVQAADLQGEGL STTATAVITVTDTNDNPPIFNPTT corresponding to amino acids 1-379 of Q9UII8, which also corresponds to amino acids 1-379 of HSECADH_P13 (SEQ ID NO:328), and a second amino acid sequence VIL corresponding to amino acids 380-382 of HSECADH_P13 (SEQ ID NO:328), wherein said first and second amino acid sequences are contiguous and in a sequential order.

Comparison report between HSECADH_P13 (SEQ ID NO:328) and CAD1_HUMAN:

1. An isolated chimeric polypeptide encoding for HSEC-ADH_P13 (SEQ ID NO:328) comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDS TYRKFSTKVTLNT VGHHHRPPPHQASVSGIQAELLT-FPNSSPGLRRQKRDWVIPPISCPENEKGPFPKNLVQI KSNKDKEGKVFYSITGQGADTP-PVGVFIIERETGWLKVTEPLDRERIATYTLFSHAVSSN GNAVEDPMEILITVTDQNDNK-PEFTQEVFKGSVMEGALPGTSVMEVTAT-DADDDVNT YNAAIAYTILSQDPELPDKNMFTINRN-TGVISVVTTGLDRSFPTYTLVVQAADLQGEGL STTATAVITVTDTNDNPPIFNPTT corresponding to amino acids 1-379 of CAD1_HUMAN, which also corresponds to amino acids 1-379 of HSECADH_P13 (SEQ ID NO:328), and a second amino acid sequence VIL corresponding to amino acids 380-382 of HSECADH_P13 (SEQ ID NO:328), wherein said first and second amino acid sequences are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSECADH_P13 (SEQ ID NO:328) also has the following non-silent SNPs (Single Nucleotide Polymorphisms) as listed in Table 12, (given according to their position(s) on the amino acid sequence, with the alternative amino acid(s) listed; the last column indicates whether the SNP is known or not; the presence of known SNPs in variant protein HSECADH_P13 (SEQ ID NO:328) sequence provides support for the deduced sequence of this variant protein according to the present invention).

TABLE 12

Amino acid mutations

| SNP position(s) on amino acid sequence | Alternative amino acid(s) | Previously known SNP? |
|---|---|---|
| 127 | P -> T | No |
| 141 | T -> A | No |

Variant protein HSECADH_P13 (SEQ ID NO:328) is encoded by the following transcript(s): HSECADH_T18 (SEQ ID NO:2), for which the sequence(s) is/are given at the end of the application. The coding portion of transcript HSECADH_T18 (SEQ ID NO:2) is shown in bold; this coding portion starts at position 125 and ends at position 1270. The transcript also has the following SNPs as listed in Table 13 (given according to their position on the nucleotide sequence, with the alternative nucleic acid listed; the last column indicates whether the SNP is known or not; the presence of known SNPs in variant protein HSECADH_P13 (SEQ ID NO:328) sequence provides support for the deduced sequence of this variant protein according to the present invention).

TABLE 13

Nucleic acid SNPs

| SNP position on nucleotide sequence | Alternative nucleic acid | Previously known SNP? |
|---|---|---|
| 71 | G -> C | Yes |
| 469 | G -> A | Yes |
| 503 | C -> A | No |
| 545 | A -> G | No |
| 847 | A -> G | No |
| 1545 | A -> G | Yes |

Variant protein HSECADH_P14 (SEQ ID NO:329) according to the present invention has an amino acid sequence as given at the end of the application; it is encoded by transcript(s) HSECADH_T19 (SEQ ID NO:3). An alignment is given to the known protein (Epithelial-cadherin precursor (SEQ ID NO:384)) at the end of the application. One or more alignments to one or more previously published protein sequences are given at the end of the application. A brief description of the relationship of the variant protein according to the present invention to each such aligned protein is as follows:

Comparison report between HSECADH_P14 (SEQ ID NO:329) and Q9UII7:

1. An isolated chimeric polypeptide encoding for HSEC-ADH_P14 (SEQ ID NO:329) comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDS TYRKFSTKVTLNT VGHHHRPPPHQASVSGIQAELLT-FPNSSPGLRRQKRDWVIPPISCPENEKGPFPKNLVQI KSNKDKEGKVFYSITGQGADTP-PVGVFIIERETGWLKVTEPLDRERIATYTLFSHAVSSN GNAVEDPMEILITVTDQNDNK-PEFTQEVFKGSVMEGALPGTSVMEVTAT-DADDDVNT YNAAIAYTILSQDPELPDKNMFTINRN-TGVISVVTTGLDRE corresponding to amino acids 1-336 of Q9UII7, which also corresponds to amino acids 1-336 of HSECADH_P14 (SEQ ID NO:329), and a second amino acid sequence being at least 70%, optionally at least 80%, preferably at least 85%, more preferably at least 90% and most preferably at least 95% homologous to a polypeptide having the sequence VRGQEDPEGVEDKCVLAQS-RGQSKILLGQLSVNTVMV (SEQ ID NO: 533) corresponding to amino acids 337-373 of HSECADH_P14 (SEQ ID NO:329), wherein said first and second amino acid sequences are contiguous and in a sequential order.

2. An isolated polypeptide encoding for a tail of HSEC-ADH_P14 (SEQ ID NO:329) comprising a polypeptide being at least 70%, optionally at least about 80%, preferably at least about 85%, more preferably at least about 90% and most preferably at least about 95% homologous to the sequence VRGQEDPEGVEDKCVLAQS-RGQSKILLGQLSVNTVMV (SEQ ID NO: 533) in HSEC-ADH_P14 (SEQ ID NO:329).

Comparison report between HSECADH_P14 (SEQ ID NO:329) and Q9UII8:

1. An isolated chimeric polypeptide encoding for HSEC-ADH_P14 (SEQ ID NO:329), comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDS TYRKFSTKVTLNT VGHHHRPPPHQASVSGIQAELLT-FPNSSPGLRRQKRDWVIPPISCPENEKGPFPKNLVQI KSNKDKEGKVFYSITGQGADTP-PVGVFIIERETGWLKVTEPLDRERIATYTLFSHAVS SN GNAVEDPMEILITVTDQNDNK-PEFTQEVFKGSVMEGALPGTSVMEVTAT-DADDDVNT YNAAIAYTILSQDPELPDKNMFTINRN-TGVISVVTTGLDRE corresponding to amino acids 1-336 of Q9UII8, which also corresponds to amino acids 1-336 of HSECADH_P14 (SEQ ID NO:329), and a second amino acid sequence being at least 70%, optionally at least 80%, preferably at least 85%, more preferably at least 90% and most preferably at least 95% homologous to a polypeptide having the sequence VRGQEDPEGVEDKCVLAQS-RGQSKILLGQLSVNTVMV (SEQ ID NO: 533) corresponding to amino acids 337-373 of HSECADH_P14 (SEQ ID NO:329), wherein said first and second amino acid sequences are contiguous and in a sequential order.

2. An isolated polypeptide encoding for a tail of HSEC-ADH_P14 (SEQ ID NO:329) comprising a polypeptide being at least 70%, optionally at least about 80%, preferably at least about 85%, more preferably at least about 90% and most preferably at least about 95% homologous to the sequence VRGQEDPEGVEDKCVLAQS-RGQSKILLGQLSVNTVMV (SEQ ID NO: 533) in HSEC-ADH_P14 (SEQ ID NO:329).

Comparison report between HSECADH_P14 (SEQ ID NO:329) and CAD1_HUMAN:

1. An isolated chimeric polypeptide encoding for HSEC-ADH_P14 (SEQ ID NO:329), comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDST YRKFSTKVTLNT VGHHHRPPPHQASVSGIQAELLTF-PNSSPGLRRQKRDWVIPPISCPENEKGPFPKNLVQI KSNKDKEGKVFYSITGQGADTP-PVGVFIIERETGWLKVTEPLDRERIATYTLFSHAVSSN GNAVEDPMEILITVTDQNDNK-PEFTQEVFKGSVMEGALPGTSVMEVTAT-DADDDVNT YNAAIAYTILSQDPELPDKNMFTINRN-TGVISVVTTGLDRE corresponding to amino acids 1-336 of CAD1_HUMAN, which also corresponds to amino acids 1-336 of HSECADH_P14 (SEQ ID NO:329), and a second amino acid sequence being at least 70%, optionally at least 80%, preferably at least 85%, more preferably at least 90% and most preferably at least 95% homologous to a polypeptide having the sequence VRGQEDPEGVEDKCVLAQS-RGQSKILLGQLSVNTVMV (SEQ ID NO: 533) corresponding to amino acids 337-373 of HSECADH_P14 (SEQ ID NO:329), wherein said first and second amino acid sequences are contiguous and in a sequential order.

2. An isolated polypeptide encoding for a tail of HSEC-ADH_P14 (SEQ ID NO:329) comprising a polypeptide being at least 70%, optionally at least about 80%, preferably at least about 85%, more preferably at least about 90% and most preferably at least about 95% homologous to the sequence VRGQEDPEGVEDKCVLAQS-RGQSKILLGQLSVNTVMV (SEQ ID NO: 533) in HSEC-ADH_P14 (SEQ ID NO:329).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSECADH_P14 (SEQ ID NO:329) also has the following non-silent SNPs (Single Nucleotide Polymorphisms) as listed in Table 14, (given according to their position(s) on the amino acid sequence, with the alternative amino acid(s) listed; the last column indicates whether the SNP is known or not; the presence of known SNPs in variant protein HSECADH_P14 (SEQ ID NO:329) sequence provides support for the deduced sequence of this variant protein according to the present invention).

TABLE 14

Amino acid mutations

| SNP position(s) on amino acid sequence | Alternative amino acid(s) | Previously known SNP? |
|---|---|---|
| 127 | P -> T | No |
| 141 | T -> A | No |

Variant protein HSECADH_P14 (SEQ ID NO:329) is encoded by the following transcript(s): HSECADH_T19 (SEQ ID NO:3), for which the sequence(s) is/are given at the end of the application. The coding portion of transcript HSECADH_T19 (SEQ ID NO:3) is shown in bold; this coding portion starts at position 125 and ends at position 1243. The transcript also has the following SNPs as listed in Table 15 (given according to their position on the nucleotide sequence, with the alternative nucleic acid listed; the last column indicates whether the SNP is known or not; the presence of known SNPs in variant protein HSECADH_P14 (SEQ ID NO:329) sequence provides support for the deduced sequence of this variant protein according to the present invention).

TABLE 15

Nucleic acid SNPs

| SNP position on nucleotide sequence | Alternative nucleic acid | Previously known SNP? |
|---|---|---|
| 71 | G -> C | Yes |
| 469 | G -> A | Yes |
| 503 | C -> A | No |
| 545 | A -> G | No |
| 847 | A -> G | No |

Variant protein HSECADH_P15 (SEQ ID NO:330) according to the present invention has an amino acid sequence as given at the end of the application; it is encoded by transcript(s) HSECADH_T20 (SEQ ID NO:4). An alignment is given to the known protein (Epithelial-cadherin precursor (SEQ ID NO:384)) at the end of the application. One or more alignments to one or more previously published protein sequences are given at the end of the application. A brief description of the relationship of the variant protein according to the present invention to each such aligned protein is as follows:

Comparison report between HSECADH_P15 (SEQ ID NO:330) and Q9UII7:

1. An isolated chimeric polypeptide encoding for HSEC-ADH_P15 (SEQ ID NO:330), comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDS TYRKFSTKVTLNT VGHHHRPPPHQASVSGIQAELLT-FPNSSPGLRRQKRDWVIPPISCPENEKGPFPKNLVQI KSNKDKEGKVFYSITGQGADTP-PVGVFIIERETGWLKVTEPLDRERIATYT corresponding to amino acids 1-229 of Q9UII7, which also corresponds to amino acids 1-229 of HSECADH_P15 (SEQ ID NO:330), and a second amino acid sequence VSIS corresponding to amino acids 230-233 of HSECADH_P15 (SEQ ID NO:330), wherein said first and second amino acid sequences are contiguous and in a sequential order.

Comparison report between HSECADH_P15 (SEQ ID NO:330) and Q9UII8:

1. An isolated chimeric polypeptide encoding for HSECADH_P15 (SEQ ID NO:330), comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDST YRKFSTKVTLNT VGHHHRPPPHQASVSGIQAELLTF-PNSSPGLRRQKRDWVIPPISCPENEKGPFPKNLVQI KSNKDKEGKVFYSITGQGADTP-PVGVFIIERETGWLKVTEPLDRERIATYT corresponding to amino acids 1-229 of Q9UII8, which also corresponds to amino acids 1-229 of HSECADH_P15 (SEQ ID NO:330), and a second amino acid sequence VSIS corresponding to amino acids 230-233 of HSECADH_P15 (SEQ ID NO:330), wherein said first and second amino acid sequences are contiguous and in a sequential order.

Comparison report between HSECADH_P15 (SEQ ID NO:330) and CAD1_HUMAN:

1. An isolated chimeric polypeptide encoding for HSECADH_P15 (SEQ ID NO:330), comprising a first amino acid sequence being at least 90% homologous to MGPWSRSL-SALLLLLQVSSWLCQEPEPCHPGFDAE-SYTFTVPRRHLERGRVLGRVNFED CTGRQRTAYF-SLDTRFKVGTDGVITVKRPLRFHNPQIHFLVYAWDS TYRKFSTKVTLNT VGHHHRPPPHQASVSGIQAELLT-FPNSSPGLRRQKRDWVIPPISCPENEKGPFPKNLVQI KSNKDKEGKVFYSITGQGADTP-PVGVFIIERETGWLKVTEPLDRERIATYT corresponding to amino acids 1-229 of CAD1_HUMAN, which also corresponds to amino acids 1-229 of HSECADH_P15 (SEQ ID NO:330), and a second amino acid sequence VSIS corresponding to amino acids 230-233 of HSECADH_P15 (SEQ ID NO:330), wherein said first and second amino acid sequences are contiguous and in a sequential order.

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSECADH_P15 (SEQ ID NO:330) also has the following non-silent SNPs (Single Nucleotide Polymorphisms) as listed in Table 16, (given according to their position(s) on the amino acid sequence, with the alternative amino acid(s) listed; the last column indicates whether the SNP is known or not; the presence of known SNPs in variant protein HSECADH_P15 (SEQ ID NO:330) sequence provides support for the deduced sequence of this variant protein according to the present invention).

TABLE 16

Amino acid mutations

| SNP position(s) on amino acid sequence | Alternative amino acid(s) | Previously known SNP? |
|---|---|---|
| 127 | P -> T | No |
| 141 | T -> A | No |

Variant protein HSECADH_P15 (SEQ ID NO:330) is encoded by the following transcript(s): HSECADH_T20 (SEQ ID NO:4), for which the sequence(s) is/are given at the end of the application. The coding portion of transcript HSECADH_T20 (SEQ ID NO:4) is shown in bold; this coding portion starts at position 125 and ends at position 823. The transcript also has the following SNPs as listed in Table 17 (given according to their position on the nucleotide sequence, with the alternative nucleic acid listed; the last column indicates whether the SNP is known or not; the presence of known SNPs in variant protein HSECADH_P15 (SEQ ID NO:330) sequence provides support for the deduced sequence of this variant protein according to the present invention).

TABLE 17

Nucleic acid SNPs

| SNP position on nucleotide sequence | Alternative nucleic acid | Previously known SNP? |
|---|---|---|
| 71 | G -> C | Yes |
| 469 | G -> A | Yes |
| 503 | C -> A | No |
| 545 | A -> G | No |
| 955 | G -> A | Yes |

As noted above, cluster HSECADH features 30 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSECADH_node_0 (SEQ ID NO:60) according to the present invention is supported by 17 libraries. The number of libraries was determined as previously described. This segment can be found in the following transcript(s): HSECADH_T11 (SEQ ID NO:1) HSECADH_T18 (SEQ ID NO:2), HSECADH_T19 (SEQ ID NO:3) and HSECADH_T20 (SEQ ID NO:4). Table 18 below describes the starting and ending position of this segment on each transcript.

TABLE 18

Segment location on transcripts

| Transcript name | Segment starting position | Segment ending position |
|---|---|---|
| HSECADH_T11 (SEQ ID NO:1) | 1 | 166 |
| HSECADH_T18 (SEQ ID NO:2) | 1 | 166 |
| HSECADH_T19 (SEQ ID NO:3) | 1 | 166 |
| HSECADH_T20 (SEQ ID NO:4) | 1 | 166 |

Segment cluster HSECADH_node__14 (SEQ ID NO:61) according to the present invention is supported by 40 libraries. The number of libraries was determined as previously described. This segment can be found in the following transcript(s): HSECADH_T11 (SEQ ID NO:1), HSECADH_T18 (SEQ ID NO:2), HSECADH_T19 (SEQ ID NO:3) and HSECADH_T20 (SEQ ID NO:4). Table 19 below describes the starting and ending position of this segment on each transcript.

TABLE 19

Segment location on transcripts

| Transcript name | Segment starting position | Segment ending position |
|---|---|---|
| HSECADH_T11 (SEQ ID NO:1) | 656 | 811 |
| HSECADH_T18 (SEQ ID NO:2) | 656 | 811 |
| HSECADH_T19 (SEQ ID NO:3) | 656 | 811 |
| HSECADH_T20 (SEQ ID NO:4) | 656 | 811 |

Segment cluster HSECADH_node__15 (SEQ ID NO:62) according to the present invention is supported by 1 libraries. The number of libraries was determined as previously described. This segment can be found in the following transcript(s): HSECADH_T20 (SEQ ID NO:4). Table 20 below describes the starting and ending position of this segment on each transcript.

TABLE 20

Segment location on transcripts

| Transcript name | Segment starting position | Segment ending position |
|---|---|---|
| HSECADH_T20 (SEQ ID NO:4) | 812 | 970 |

Segment cluster HSECADH_node__21 (SEQ ID NO:63) according to the present invention is supported by 40 libraries. The number of libraries was determined as previously described. This segment can be found in the following transcript(s): HSECADH_T18 (SEQ ID NO:2) and HSECADH_T19 (SEQ ID NO:3). Table 21 below describes the starting and ending position of this segment on each transcript.

TABLE 21

Segment location on transcripts

| Transcript name | Segment starting position | Segment ending position |
|---|---|---|
| HSECADH_T18 (SEQ ID NO:2) | 957 | 1132 |
| HSECADH_T19 (SEQ ID NO:3) | 957 | 1132 |

Segment cluster HSECADH_node__22 (SEQ ID NO:64) according to the present invention is supported by 1 libraries. The number of libraries was determined as previously described. This segment can be found in the following transcript(s): HSECADH_T19 (SEQ ID NO:3). Table 22 below describes the starting and ending position of this segment on each transcript.

TABLE 22

Segment location on transcripts

| Transcript name | Segment starting position | Segment ending position |
|---|---|---|
| HSECADH_T19 (SEQ ID NO:3) | 1133 | 1269 |

Segment cluster HSECADH_node__25 (SEQ ID NO:65) according to the present invention is supported by 34 libraries. The number of libraries was determined as previously described. This segment can be found in the following transcript(s): HSECADH_T18 (SEQ ID NO:2). Table 23 below describes the starting and ending position of this segment on each transcript.

TABLE 23

Segment location on transcripts

| Transcript name | Segment starting position | Segment ending position |
|---|---|---|
| HSECADH_T18 (SEQ ID NO:2) | 1133 | 1261 |

Segment cluster HSECADH_node__26 (SEQ ID NO:66) according to the present invention is supported by 1 libraries. The number of libraries was determined as previously described. This segment can be found in the following transcript(s): HSECADH_T18 (SEQ ID NO:2). Table 24 below describes the starting and ending position of this segment on each transcript.

TABLE 24

Segment location on transcripts

| Transcript name | Segment starting position | Segment ending position |
|---|---|---|
| HSECADH_T18 (SEQ ID NO:2) | 1262 | 1584 |

Segment cluster HSECADH_node__48 (SEQ ID NO:67) according to the present invention is supported by 44 libraries. The number of libraries was determined as previously described. This segment can be found in the following transcript(s): HSECADH_T11 (SEQ ID NO:1). Table 25 below describes the starting and ending position of this segment on each transcript.

TABLE 25

Segment location on transcripts

| Transcript name | Segment starting position | Segment ending position |
|---|---|---|
| HSECADH_T11 (SEQ ID NO:1) | 1149 | 1292 |

Segment cluster HSECADH_node__52 (SEQ ID NO:68) according to the present invention is supported by 39 libraries. The number of libraries was determined as previously described. This segment can be found in the following transcript(s): HSECADH_T11 (SEQ ID NO:1). Table 26 below describes the starting and ending position of this segment on each transcript.

TABLE 26

Segment location on transcripts

| Transcript name | Segment starting position | Segment ending position |
|---|---|---|
| HSECADH_T11 (SEQ ID NO:1) | 1293 | 1449 |

Segment cluster HSECADH_node__53 (SEQ ID NO:69) according to the present invention is supported by 59 libraries. The number of libraries was determined as previously described. This segment can be found in the following transcript(s): HSECADH_T11 (SEQ ID NO:1). Table 27 below describes the starting and ending position of this segment on each transcript.

TABLE 27

Segment location on transcripts

| Transcript name | Segment starting position | Segment ending position |
|---|---|---|
| HSECADH_T11 (SEQ ID NO:1) | 1450 | 1933 |

Segment cluster HSECADH_node__54 (SEQ ID NO:70) according to the present invention is supported by 44 libraries. The number of libraries was determined as previously described. This segment can be found in the following transcript(s): HSECADH_T11 (SEQ ID NO:1). Table 28 below describes the starting and ending position of this segment on each transcript.

TABLE 28

Segment location on transcripts

| Transcript name | Segment starting position | Segment ending position |
|---|---|---|
| HSECADH_T11 (SEQ ID NO:1) | 1934 | 2053 |

Segment cluster HSECADH_node__57 (SEQ ID NO:71) according to the present invention is supported by 67 libraries. The number of libraries was determined as previously described. This segment can be found in the following transcript(s): HSECADH_T11 (SEQ ID NO:1). Table 29 below describes the starting and ending position of this segment on each transcript.

TABLE 29

Segment location on transcripts

| Transcript name | Segment starting position | Segment ending position |
|---|---|---|
| HSECADH_T11 (SEQ ID NO:1) | 2241 | 2430 |

Segment cluster HSECADH_node__60 (SEQ ID NO:72) according to the present invention is supported by 260 libraries. The number of libraries was determined as previously described. This segment can be found in the following transcript(s): HSECADH_T11 (SEQ ID NO:1). Table 30 below describes the starting and ending position of this segment on each transcript.

TABLE 30

Segment location on transcripts

| Transcript name | Segment starting position | Segment ending position |
|---|---|---|
| HSECADH_T11 (SEQ ID NO:1) | 2504 | 3096 |

Segment cluster HSECADH_node__62 (SEQ ID NO:73) according to the present invention is supported by 173 libraries. The number of libraries was determined as previously described. This segment can be found in the following transcript(s): HSECADH_T11 (SEQ ID NO:1). Table 31 below describes the starting and ending position of this segment on each transcript.

TABLE 31

Segment location on transcripts

| Transcript name | Segment starting position | Segment ending position |
|---|---|---|
| HSECADH_T11 (SEQ ID NO:1) | 3097 | 3245 |

Segment cluster HSECADH_node__63 (SEQ ID NO:74) according to the present invention is supported by 162 libraries. The number of libraries was determined as previously described. This segment can be found in the following transcript(s): HSECADH T11 (SEQ ID NO:1). Table 32 below describes the starting and ending position of this segment on each transcript.

TABLE 32

Segment location on transcripts

| Transcript name | Segment starting position | Segment ending position |
|---|---|---|
| HSECADH_T11 (SEQ ID NO:1) | 3246 | 3544 |

Segment cluster HSECADH_node__7 (SEQ ID NO:75) according to the present invention is supported by 21 libraries. The number of libraries was determined as previously described. This segment can be found in the following transcript(s): HSECADH_T11 (SEQ ID NO:1), HSECADH_T18 (SEQ ID NO:2), HSECADH_T19 (SEQ ID NO:3) and HSECADH_T20 (SEQ ID NO:4). Table 33 below describes the starting and ending position of this segment on each transcript.

TABLE 33

Segment location on transcripts

| Transcript name | Segment starting position | Segment ending position |
|---|---|---|
| HSECADH_T11 (SEQ ID NO:1) | 288 | 511 |
| HSECADH_T18 (SEQ ID NO:2) | 288 | 511 |
| HSECADH_T19 (SEQ ID NO:3) | 288 | 511 |
| HSECADH_T20 (SEQ ID NO:4) | 288 | 511 |

According to an optional embodiment of the present invention, short segments related to the above cluster are also provided. These segments are up to about 120 bp in length, and so are included in a separate description.

Segment cluster HSECADH_node_1 (SEQ ID NO:76) according to the present invention can be found in the following transcript(s): HSECADH_T11 (SEQ ID NO:1), HSECADH_T18 (SEQ ID NO:2), HSECADH_T19 (SEQ ID NO:3) and HSECADH_T20 (SEQ ID NO:4). Table 34 below describes the starting and ending position of this segment on each transcript.

TABLE 34

Segment location on transcripts

| Transcript name | Segment starting position | Segment ending position |
|---|---|---|
| HSECADH_T11 (SEQ ID NO:1) | 167 | 172 |
| HSECADH_T18 (SEQ ID NO:2) | 167 | 172 |
| HSECADH_T19 (SEQ ID NO:3) | 167 | 172 |
| HSECADH_T20 (SEQ ID NO:4) | 167 | 172 |

Segment cluster HSECADH_node_11 (SEQ ID NO:77) according to the present invention is supported by 23 libraries. The number of libraries was determined as previously described. This segment can be found in the following transcript(s): HSECADH_T11 (SEQ ID NO:1), HSECADH_T18 (SEQ ID NO:2), HSECADH_T19 (SEQ ID NO:3) and HSECADH_T20 (SEQ ID NO:4). Table 35 below describes the starting and ending position of this segment on each transcript.

TABLE 35

Segment location on transcripts

| Transcript name | Segment starting position | Segment ending position |
|---|---|---|
| HSECADH_T11 (SEQ ID NO:1) | 512 | 592 |
| HSECADH_T18 (SEQ ID NO:2) | 512 | 592 |
| HSECADH_T19 (SEQ ID NO:3) | 512 | 592 |
| HSECADH_T20 (SEQ ID NO:4) | 512 | 592 |

Segment cluster HSECADH_node_12 (SEQ ID NO:78) according to the present invention is supported by 26 libraries. The number of libraries was determined as previously described. This segment can be found in the following transcript(s): HSECADH_T11 (SEQ ID NO:1), HSECADH_T18 (SEQ ID NO:2), HSECADH_T19 (SEQ ID NO:3) and HSECADH_T20 (SEQ ID NO:4). Table 36 below describes the starting and ending position of this segment on each transcript.

TABLE 36

Segment location on transcripts

| Transcript name | Segment starting position | Segment ending position |
|---|---|---|
| HSECADH_T11 (SEQ ID NO:1) | 593 | 655 |
| HSECADH_T18 (SEQ ID NO:2) | 593 | 655 |
| HSECADH_T19 (SEQ ID NO:3) | 593 | 655 |
| HSECADH_T20 (SEQ ID NO:4) | 593 | 655 |

Segment cluster HSECADH_node_17 (SEQ ID NO:79) according to the present invention can be found in the following transcript(s): HSECADH_T11 (SEQ ID NO:1), HSECADH_T18 (SEQ ID NO:2) and HSECADH_T19 (SEQ ID NO:3). Table 37 below describes the starting and ending position of this segment on each transcript.

TABLE 37

Segment location on transcripts

| Transcript name | Segment starting position | Segment ending position |
|---|---|---|
| HSECADH_T11 (SEQ ID NO:1) | 812 | 827 |
| HSECADH_T18 (SEQ ID NO:2) | 812 | 827 |
| HSECADH_T19 (SEQ ID NO:3) | 812 | 827 |

Segment cluster HSECADH_node_18 (SEQ ID NO:80) according to the present invention is supported by 41 libraries. The number of libraries was determined as previously described. This segment can be found in the following transcript(s): HSECADH_T11 (SEQ ID NO:1), HSECADH_T18 (SEQ ID NO:2) and HSECADH_T19 (SEQ ID NO:3). Table 38 below describes the starting and ending position of this segment on each transcript.

TABLE 38

Segment location on transcripts

| Transcript name | Segment starting position | Segment ending position |
|---|---|---|
| HSECADH_T11 (SEQ ID NO:1) | 828 | 944 |
| HSECADH_T18 (SEQ ID NO:2) | 828 | 944 |
| HSECADH_T19 (SEQ ID NO:3) | 828 | 944 |

Segment cluster HSECADH_node_19 (SEQ ID NO:81) according to the present invention can be found in the following transcript(s): HSECADH_T18 (SEQ ID NO:2) and HSECADH_T19 (SEQ ID NO:3). Table 39 below describes the starting and ending position of this segment on each transcript.

TABLE 39

Segment location on transcripts

| Transcript name | Segment starting position | Segment ending position |
|---|---|---|
| HSECADH_T18 (SEQ ID NO:2) | 945 | 956 |
| HSECADH_T19 (SEQ ID NO:3) | 945 | 956 |

Segment cluster HSECADH_node_3 (SEQ ID NO:82) according to the present invention is supported by 18 libraries. The number of libraries was determined as previously described.

This segment can be found in the following transcript(s): HSECADH_T11 (SEQ ID NO:1), HSECADH_T18 (SEQ ID NO:2), HSECADH_T19 (SEQ ID NO:3) and HSECADH_T20 (SEQ ID NO:4). Table 40 below describes the starting and ending position of this segment on each transcript.

TABLE 40

Segment location on transcripts

| Transcript name | Segment starting position | Segment ending position |
|---|---|---|
| HSECADH_T11 (SEQ ID NO:1) | 173 | 287 |
| HSECADH_T18 (SEQ ID NO:2) | 173 | 287 |
| HSECADH_T19 (SEQ ID NO:3) | 173 | 287 |
| HSECADH_T20 (SEQ ID NO:4) | 173 | 287 |

Segment cluster HSECADH_node__42 (SEQ ID NO:83) according to the present invention is supported by 43 libraries. The number of libraries was determined as previously described. This segment can be found in the following transcript(s): HSECADH_T11 (SEQ ID NO:1). Table 41 below describes the starting and ending position of this segment on each transcript.

TABLE 41

Segment location on transcripts

| Transcript name | Segment starting position | Segment ending position |
|---|---|---|
| HSECADH_T11 (SEQ ID NO:1) | 945 | 1017 |

Segment cluster HSECADH_node__45 (SEQ ID NO:84) according to the present invention is supported by 39 libraries. The number of libraries was determined as previously described. This segment can be found in the following transcript(s): HSECADH_T11 (SEQ ID NO:1). Table 42 below describes the starting and ending position of this segment on each transcript.

TABLE 42

Segment location on transcripts

| Transcript name | Segment starting position | Segment ending position |
|---|---|---|
| HSECADH_T11 (SEQ ID NO:1) | 1018 | 1051 |

Segment cluster HSECADH_node__46 (SEQ ID NO:85) according to the present invention is supported by 40 libraries. The number of libraries was determined as previously described. This segment can be found in the following transcript(s): HSECADH_T11 (SEQ ID NO:1). Table 43 below describes the starting and ending position of this segment on each transcript.

TABLE 43

Segment location on transcripts

| Transcript name | Segment starting position | Segment ending position |
|---|---|---|
| HSECADH_T11 (SEQ ID NO:1) | 1052 | 1148 |

Segment cluster HSECADH_node__55 (SEQ ID NO:86) according to the present invention is supported by 36 libraries. The number of libraries was determined as previously described. This segment can be found in the following transcript(s): HSECADH_T11 (SEQ ID NO:1). Table 44 below describes the starting and ending position of this segment on each transcript.

TABLE 44

Segment location on transcripts

| Transcript name | Segment starting position | Segment ending position |
|---|---|---|
| HSECADH_T11 (SEQ ID NO:1) | 2054 | 2166 |

Segment cluster HSECADH_node__56 (SEQ ID NO:87) according to the present invention is supported by 42 libraries. The number of libraries was determined as previously described. This segment can be found in the following transcript(s): HSECADH_T11 (SEQ ID NO:1). Table 45 below describes the starting and ending position of this segment on each transcript.

TABLE 45

Segment location on transcripts

| Transcript name | Segment starting position | Segment ending position |
|---|---|---|
| HSECADH_T11 (SEQ ID NO:1) | 2167 | 2240 |

Segment cluster HSECADH_node__58 (SEQ ID NO:88) according to the present invention is supported by 61 libraries. The number of libraries was determined as previously described. This segment can be found in the following transcript(s): HSECADH_T11 (SEQ ID NO:1). Table 46 below describes the starting and ending position of this segment on each transcript.

TABLE 46

Segment location on transcripts

| Transcript name | Segment starting position | Segment ending position |
|---|---|---|
| HSECADH_T11 (SEQ ID NO:1) | 2431 | 2481 |

Segment cluster HSECADH_node__59 (SEQ ID NO:89) according to the present invention can be found in the following transcript(s): HSECADH_T11 (SEQ ID NO:1). Table 47 below describes the starting and ending position of this segment on each transcript.

TABLE 47

Segment location on transcripts

| Transcript name | Segment starting position | Segment ending position |
|---|---|---|
| HSECADH_T11 (SEQ ID NO:1) | 2482 | 2503 |

Variant Protein Alignment to the Previously Known Protein:

```
Sequence name: /tmp/2x0I2XZ1A3/JXvUszCm3O:Q9UII7
Sequence documentation:
Alignment of: HSECADH_P9 (SEQ ID NO:327) x Q9UII7 . . .
Alignment segment 1/1:
  Quality:                                    2727.00
  Escore:                                           0
  Matching length:                                274
  Total length:                                   274
```

-continued

```
Matching Percent Similarity:          100.00
Matching Percent Identity:            100.00
Total Percent Similarity:             100.00
Total Percent Identity:               100.00
Gaps:                                      0
Alignment:

1  MGPWSRSLSALLLLLQVSSWLCQEPEPCHPGFDAESYTFTVPRRHLERGR   50
     ||||||||||||||||||||||||||||||||||||||||||||||||||
  1  MGPWSRSLSALLLLLQVSSWLCQEPEPCHPGFDAESYTFTVPRRHLERGR   50

51  VLGRVNFEDCTGRQRTAYFSLDTRFKVGTDGVITVKRPLRFHNPQIHFLV  100
     ||||||||||||||||||||||||||||||||||||||||||||||||||
 51  VLGRVNFEDCTGRQRTAYFSLDTRFKVGTDGVITVKRPLRFHNPQIHFLV  100

101  YAWDSTYRKFSTKVTLNTVGHHHRPPPHQASVSGIQAELLTFPNSSPGLR  150
     ||||||||||||||||||||||||||||||||||||||||||||||||||
101  YAWDSTYRKFSTKVTLNTVGHHHRPPPHQASVSGIQAELLTFPNSSPGLR  150

151  RQKRDWVIPPISCPENEKGPFPKNLVQIKSNKDKEGKVFYSITGQGADTP  200
     ||||||||||||||||||||||||||||||||||||||||||||||||||
151  RQKRDWVIPPISCPENEKGPFPKNLVQIKSNKDKEGKVFYSITGQGADTP  200

201  PVGVFIIERETGWLKVTEPLDRERIATYTLFSHAVSSNGNAVEDPMEILI  250
     ||||||||||||||||||||||||||||||||||||||||||||||||||
201  PVGVFIIERETGWLKVTEPLDRERIATYTLFSHAVSSNGNAVEDPMEILI  250

251  TVTDQNDNKPEFTQEVFKGSVMEG                          274
     ||||||||||||||||||||||||
251  TVTDQNDNKPEFTQEVFKGSVMEG                          274

Sequence name: /tmp/2x0I2XZ1A3/JXvUszCm3O:Q9UII8
Sequence documentation:
Alignment of: HSECADH_P9 (SEQ ID NO:327) x Q9UII8 . . .
Alignment segment 1/1:
Quality:                             2727.00
Escore:                                    0
Matching length:                         274
Total length:                            274
Matching Percent Similarity:          100.00
Matching Percent Identity:            100.00
Total Percent Similarity:             100.00
Total Percent Identity:               100.00
Gaps:                                      0
Alignment:

1  MGPWSRSLSALLLLLQVSSWLCQEPEPCHPGFDAESYTFTVPRRHLERGR   50
     ||||||||||||||||||||||||||||||||||||||||||||||||||
  1  MGPWSRSLSALLLLLQVSSWLCQEPEPCHPGFDAESYTFTVPRRHLERGR   50

51  VLGRVNFEDCTGRQRTAYFSLDTRFKVGTDGVITVKRPLRFHNPQIHFLV  100
     ||||||||||||||||||||||||||||||||||||||||||||||||||
 51  VLGRVNFEDCTGRQRTAYFSLDTRFKVGTDGVITVKRPLRFHNPQIHFLV  100

101  YAWDSTYRKFSTKVTLNTVGHHHRPPPHQASVSGIQAELLTFPNSSPGLR  150
     ||||||||||||||||||||||||||||||||||||||||||||||||||
101  YAWDSTYRKFSTKVTLNTVGHHHRPPPHQASVSGIQAELLTFPNSSPGLR  150

151  RQKRDWVIPPISCPENEKGPFPKNLVQIKSNKDKEGKVFYSITGQGADTP  200
     ||||||||||||||||||||||||||||||||||||||||||||||||||
151  RQKRDWVIPPISCPENEKGPFPKNLVQIKSNKDKEGKVFYSITGQGADTP  200

201  PVGVFIIERETGWLKVTEPLDRERIATYTLFSHAVSSNGNAVEDPMEILI  250
     ||||||||||||||||||||||||||||||||||||||||||||||||||
201  PVGVFIIERETGWLKVTEPLDRERIATYTLFSHAVSSNGNAVEDPMEILI  250
```

```
251   TVTDQNDNKPEFTQEVFKGSVMEG                                      274
      ||||||||||||||||||||||||
251   TVTDQNDNKPEFTQEVFKGSVMEG                                      274
```

Sequence name: /tmp/2x0I2XZ1A3/JXvUszCm3O:CAD1_HUMAN
Sequence documentation:
Alignment of: HSECADH_P9 (SEQ ID NO:327) x CAD1_HUMAN . . .
Alignment segment 1/1:
Quality:                           2727.00
Escore:                                  0
Matching length:                       274
Total length:                          274
Matching Percent Similarity:        100.00
Matching Percent Identity:          100.00
Total Percent Similarity:           100.00
Total Percent Identity:             100.00
Gaps:                                    0
Alignment:

```
  1   MGPWSRSLSALLLLLQVSSWLCQEPEPCHPGFDAESYTFTVPRRHLERGR              50
      ||||||||||||||||||||||||||||||||||||||||||||||||||
  1   MGPWSRSLSALLLLLQVSSWLCQEPEPCHPGFDAESYTFTVPRRHLERGR              50

51   VLGRVNFEDCTGRQRTAYFSLDTRFKVGTDGVITVKRPLRFHNPQIHFLV             100
      ||||||||||||||||||||||||||||||||||||||||||||||||||
 51   VLGRVNFEDCTGRQRTAYFSLDTRFKVGTDGVITVKRPLRFHNPQIHFLV             100

101   YAWDSTYRKFSTKVTLNTVGHHHRPPPHQASVSGIQAELLTFPNSSPGLR             150
      ||||||||||||||||||||||||||||||||||||||||||||||||||
101   YAWDSTYRKFSTKVTLNTVGHHHRPPPHQASVSGIQAELLTFPNSSPGLR             150

151   RQKRDWVIPPISCPENEKGPFPKNLVQIKSNKDKEGKVFYSITGQGADTP             200
      ||||||||||||||||||||||||||||||||||||||||||||||||||
151   RQKRDWVIPPISCPENEKGPFPKNLVQIKSNKDKEGKVFYSITGQGADTP             200

201   PVGVFIIERETGWLKVTEPLDRERIATYTLFSHAVSSNGNAVEDPMEILI             250
      ||||||||||||||||||||||||||||||||||||||||||||||||||
201   PVGVFIIERETGWLKVTEPLDRERIATYTLFSHAVSSNGNAVEDPMEILI             250

251   TVTDQNDNKPEFTQEVFKGSVMEG                                      274
      ||||||||||||||||||||||||
251   TVTDQNDNKPEFTQEVFKGSVMEG                                      274
```

Sequence name: /tmp/e5Y8HiBmjB/iwyb1d8ik1:Q9UII7
Sequence documentation:
Alignment of: HSECADH_P13 (SEQ ID NO:328) x Q9UII7 . . .
Alignment segment 1/1:
Quality:                           3720.00
Escore:                                  0
Matching length:                       379
Total length:                          379
Matching Percent Similarity:        100.00
Matching Percent Identity:          100.00
Total Percent Similarity:           100.00
Total Percent Identity:             100.00
Gaps:                                    0
Alignment:

```
  1   MGPWSRSLSALLLLLQVSSWLCQEPEPCHPGFDAESYTFTVPRRHLERGR              50
      ||||||||||||||||||||||||||||||||||||||||||||||||||
  1   MGPWSRSLSALLLLLQVSSWLCQEPEPCHPGFDAESYTFTVPRRHLERGR              50

51   VLGRVNFEDCTGRQRTAYFSLDTRFKVGTDGVITVKRPLRFHNPQIHFLV             100
      ||||||||||||||||||||||||||||||||||||||||||||||||||
 51   VLGRVNFEDCTGRQRTAYFSLDTRFKVGTDGVITVKRPLRFHNPQIHFLV             100

101   YAWDSTYRKFSTKVTLNTVGHHHRPPPHQASVSGIQAELLTFPNSSPGLR             150
      ||||||||||||||||||||||||||||||||||||||||||||||||||
101   YAWDSTYRKFSTKVTLNTVGHHHRPPPHQASVSGIQAELLTFPNSSPGLR             150
```

```
151  RQKRDWVIPPISCPENEKGPFPKNLVQIKSNKDKEGKVFYSITGQGADTP  200
     |||||||||||||||||||||||||||||||||||||||||||||||||
151  RQKRDWVIPPISCPENEKGPFPKNLVQIKSNKDKEGKVFYSITGQGADTP  200

201  PVGVFIIERETGWLKVTEPLDRERIATYTLFSHAVSSNGNAVEDPMEILI  250
     |||||||||||||||||||||||||||||||||||||||||||||||||
201  PVGVFIIERETGWLKVTEPLDRERIATYTLFSHAVSSNGNAVEDPMEILI  250

251  TVTDQNDNKPEFTQEVFKGSVMEGALPGTSVMEVTATDADDDVNTYNAAI  300
     |||||||||||||||||||||||||||||||||||||||||||||||||
251  TVTDQNDNKPEFTQEVFKGSVMEGALPGTSVMEVTATDADDDVNTYNAAI  300

301  AYTILSQDPELPDKNMFTINRNTGVISVVTTGLDRESFPTYTLVVQAADL  350
     |||||||||||||||||||||||||||||||||||||||||||||||||
301  AYTILSQDPELPDKNMFTINRNTGVISVVTTGLDRESFPTYTLVVQAADL  350

351  QGEGLSTTATAVITVTDTNDNPPIFNPTT                      379
     |||||||||||||||||||||||||||||
351  QGEGLSTTATAVITVTDTNDNPPIFNPTT                      379

Sequence name: /tmp/e5Y8HiBmjB/iwyb1d8ikl:Q9UII8
Sequence documentation:
Alignment of: HSECADH_P13 (SEQ ID NO:328) x Q9UII8 . . .
Alignment segment 1/1:
Quality:                           3720.00
Escore:                                  0
Matching length:                       379
Total length:                          379
Matching Percent Similarity:        100.00
Matching Percent Identity:          100.00
Total Percent Similarity:           100.00
Total Percent Identity:             100.00
Gaps:                                    0
Alignment:

1  MGPWSRSLSALLLLLQVSSWLCQEPEPCHPGFDAESYTFTVPRRHLERGR   50
     |||||||||||||||||||||||||||||||||||||||||||||||||
  1  MGPWSRSLSALLLLLQVSSWLCQEPEPCHPGFDAESYTFTVPRRHLERGR   50

51  VLGRVNFEDCTGRQRTAYFSLDTRFKVGTDGVITVKRPLRFHNPQIHFLV  100
     |||||||||||||||||||||||||||||||||||||||||||||||||
 51  VLGRVNFEDCTGRQRTAYFSLDTRFKVGTDGVITVKRPLRFHNPQIHFLV  100

101  YAWDSTYRKFSTKVTLNTVGHHHRPPPHQASVSGIQAELLTFPNSSPGLR  150
     |||||||||||||||||||||||||||||||||||||||||||||||||
101  YAWDSTYRKFSTKVTLNTVGHHHRPPPHQASVSGIQAELLTFPNSSPGLR  150

151  RQKRDWVIPPISCPENEKGPFPKNLVQIKSNKDKEGKVFYSITGQGADTP  200
     |||||||||||||||||||||||||||||||||||||||||||||||||
151  RQKRDWVIPPISCPENEKGPFPKNLVQIKSNKDKEGKVFYSITGQGADTP  200

201  PVGVFIIERETGWLKVTEPLDRERIATYTLFSHAVSSNGNAVEDPMEILI  250
     |||||||||||||||||||||||||||||||||||||||||||||||||
201  PVGVFIIERETGWLKVTEPLDRERIATYTLFSHAVSSNGNAVEDPMEILI  250

251  TVTDQNDNKPEFTQEVFKGSVMEGALPGTSVMEVTATDADDDVNTYNAAI  300
     |||||||||||||||||||||||||||||||||||||||||||||||||
251  TVTDQNDNKPEFTQEVFKGSVMEGALPGTSVMEVTATDADDDVNTYNAAI  300

301  AYTILSQDPELPDKNMFTINRNTGVISVVTTGLDRESFPTYTLVVQAADL  350
     |||||||||||||||||||||||||||||||||||||||||||||||||
301  AYTILSQDPELPDKNMFTINRNTGVISVVTTGLDRESFPTYTLVVQAADL  350

351  QGEGLSTTATAVITVTDTNDNPPIFNPTT                      379
     ||||||||||||||||||||||||||||
351  QGEGLSTTATAVITVTDTNDNPPIFNPTT                      379
```

```
Sequence name: /tmp/e5Y8HiBmjB/iwyb1d8ik1:CAD1_HUMAN
Sequence documentation:
Alignment of: HSECADH_P13 (SEQ ID NO:328) x CAD1_HUMAN . . .
Alignment segment 1/1:
Quality:                          3720.00
Escore:                                 0
Matching length:                      379
Total length:                         379
Matching Percent Similarity:       100.00
Matching Percent Identity:         100.00
Total Percent Similarity:          100.00
Total Percent Identity:            100.00
Gaps:                                   0
Alignment:

1   MGPWSRSLSALLLLLQVSSWLCQEPEPCHPGFDAESYTFTVPRRHLERGR    50
      ||||||||||||||||||||||||||||||||||||||||||||||||||
  1   MGPWSRSLSALLLLLQVSSWLCQEPEPCHPGFDAESYTFTVPRRHLERGR    50

51   VLGRVNFEDCTGRQRTAYFSLDTRFKVGTDGVITVKRPLRFHNPQIHFLV   100
      ||||||||||||||||||||||||||||||||||||||||||||||||||
 51   VLGRVNFEDCTGRQRTAYFSLDTRFKVGTDGVITVKRPLRFHNPQIHFLV   100

101   YAWDSTYRKFSTKVTLNTVGHHHRPPPHQASVSGIQAELLTFPNSSPGLR   150
      ||||||||||||||||||||||||||||||||||||||||||||||||||
101   YAWDSTYRKFSTKVTLNTVGHHHRPPPHQASVSGIQAELLTFPNSSPGLR   150

151   RQKRDWVIPPISCPENEKGPFPKNLVQIKSNKDKEGKVFYSITGQGADTP   200
      ||||||||||||||||||||||||||||||||||||||||||||||||||
151   RQKRDWVIPPISCPENEKGPFPKNLVQIKSNKDKEGKVFYSITGQGADTP   200

201   PVGVFIIERETGWLKVTEPLDRERIATYTLFSHAVSSNGNAVEDPMEILI   250
      ||||||||||||||||||||||||||||||||||||||||||||||||||
201   PVGVFIIERETGWLKVTEPLDRERIATYTLFSHAVSSNGNAVEDPMEILI   250

251   TVTDQNDNKPEFTQEVFKGSVMEGALPGTSVMEVTATDADDDVNTYNAAI   300
      ||||||||||||||||||||||||||||||||||||||||||||||||||
251   TVTDQNDNKPEFTQEVFKGSVMEGALPGTSVMEVTATDADDDVNTYNAAI   300

301   AYTILSQDPELPDKNMFTINRNTGVISVVTTGLDRESFPTYTLVVQAADL   350
      ||||||||||||||||||||||||||||||||||||||||||||||||||
301   AYTILSQDPELPDKNMFTINRNTGVISVVTTGLDRESFPTYTLVVQAADL   350

351   QGEGLSTTATAVITVTDTNDNPPIFNPTT                        379
      |||||||||||||||||||||||||||||
351   QGEGLSTTATAVITVTDTNDNPPIFNPTT                        379

Sequence name: /tmp/RtiX8vFyZe/iovNeRHKWU:Q9UII7
Sequence documentation:
Alignment of: HSECADH_P14 (SEQ ID NO:329) x Q9UII7 . . .
Alignment segment 1/1:
Quality:                          3313.00
Escore:                                 0
Matching length:                      336
Total length:                         336
Matching Percent Similarity:       100.00
Matching Percent Identity:         100.00
Total Percent Similarity:          100.00
Total Percent Identity:            100.00
Gaps:                                   0
Alignment:

1   MGPWSRSLSALLLLLQVSSWLCQEPEPCHPGFDAESYTFTVPRRHLERGR    50
      ||||||||||||||||||||||||||||||||||||||||||||||||||
  1   MGPWSRSLSALLLLLQVSSWLCQEPEPCHPGFDAESYTFTVPRRHLERGR    50

51   VLGRVNFEDCTGRQRTAYFSLDTRFKVGTDGVITVKRPLRFHNPQIHFLV   100
      ||||||||||||||||||||||||||||||||||||||||||||||||||
 51   VLGRVNFEDCTGRQRTAYFSLDTRFKVGTDGVITVKRPLRFHNPQIHFLV   100
```

```
101  YAWDSTYRKFSTKVTLNTVGHHHRPPPHQASVSGIQAELLTFPNSSPGLR    150
     ||||||||||||||||||||||||||||||||||||||||||||||||||
101  YAWDSTYRKFSTKVTLNTVGHHHRPPPHQASVSGIQAELLTFPNSSPGLR    150

151  RQKRDWVIPPISCPENEKGPFPKNLVQIKSNKDKEGKVFYSITGQGADTP    200
     ||||||||||||||||||||||||||||||||||||||||||||||||||
151  RQKRDWVIPPISCPENEKGPFPKNLVQIKSNKDKEGKVFYSITGQGADTP    200

201  PVGVFIIERETGWLKVTEPLDRERIATYTLFSHAVSSNGNAVEDPMEILI    250
     ||||||||||||||||||||||||||||||||||||||||||||||||||
201  PVGVFIIERETGWLKVTEPLDRERIATYTLFSHAVSSNGNAVEDPMEILI    250

251  TVTDQNDNKPEFTQEVFKGSVMEGALPGTSVMEVTATDADDDVNTYNAAI    300
     ||||||||||||||||||||||||||||||||||||||||||||||||||
251  TVTDQNDNKPEFTQEVFKGSVMEGALPGTSVMEVTATDADDDVNTYNAAI    300

301  AYTILSQDPELPDKNMFTINRNTGVISVVTTGLDRE                 336
     |||||||||||||||||||||||||||||||||||
301  AYTILSQDPELPDKNMFTINRNTGVISVVTTGLDRE                 336

Sequence name: /tmp/RtiX8vFyZe/iovNeRHKWU:Q9UII8
Sequence documentation:
Alignment of: HSECADH_P14 (SEQ ID NO:329) x Q9UII8 . . .
Alignment segment 1/1:
Quality:                                3313.00
Escore:                                       0
Matching length:                            336
Total length:                               336
Matching Percent Similarity:             100.00
Matching Percent Identity:               100.00
Total Percent Similarity:                100.00
Total Percent Identity:                  100.00
Gaps:                                         0
Alignment:

1  MGPWSRSLSALLLLLQVSSWLCQEPEPCHPGFDAESYTFTVPRRHLERGR     50
     ||||||||||||||||||||||||||||||||||||||||||||||||||
  1  MGPWSRSLSALLLLLQVSSWLCQEPEPCHPGFDAESYTFTVPRRHLERGR     50

51  VLGRVNFEDCTGRQRTAYFSLDTRFKVGTDGVITVKRPLRFHNPQIHFLV    100
     ||||||||||||||||||||||||||||||||||||||||||||||||||
 51  VLGRVNFEDCTGRQRTAYFSLDTRFKVGTDGVITVKRPLRFHNPQIHFLV    100

101  YAWDSTYRKFSTKVTLNTVGHHHRPPPHQASVSGIQAELLTFPNSSPGLR    150
     ||||||||||||||||||||||||||||||||||||||||||||||||||
101  YAWDSTYRKFSTKVTLNTVGHHHRPPPHQASVSGIQAELLTFPNSSPGLR    150

151  RQKRDWVIPPISCPENEKGPFPKNLVQIKSNKDKEGKVFYSITGQGADTP    200
     ||||||||||||||||||||||||||||||||||||||||||||||||||
151  RQKRDWVIPPISCPENEKGPFPKNLVQIKSNKDKEGKVFYSITGQGADTP    200

201  PVGVFIIERETGWLKVTEPLDRERIATYTLFSHAVSSNGNAVEDPMEILI    250
     ||||||||||||||||||||||||||||||||||||||||||||||||||
201  PVGVFIIERETGWLKVTEPLDRERIATYTLFSHAVSSNGNAVEDPMEILI    250

251  TVTDQNDNKPEFTQEVFKGSVMEGALPGTSVMEVTATDADDDVNTYNAAI    300
     ||||||||||||||||||||||||||||||||||||||||||||||||||
251  TVTDQNDNKPEFTQEVFKGSVMEGALPGTSVMEVTATDADDDVNTYNAAI    300

301  AYTILSQDPELPDKNMFTINRNTGVISVVTTGLDRE                 336
     |||||||||||||||||||||||||||||||||||
301  AYTILSQDPELPDKNMFTINRNTGVISVVTTGLDRE                 336

Sequence name: /tmp/RtiX8vFyZe/iovNeRHKWU:CAD1_HUMAN
Sequence documentation:
Alignment of: HSECADH_P14 (SEQ ID NO:329) x CAD1_HUMAN . . .
Alignment segment 1/1:
```

```
Quality:                        3313.00
Escore:                               0
Matching length:                    336
Total length:                       336
Matching Percent Similarity:     100.00
Matching Percent Identity:       100.00
Total Percent Similarity:        100.00
Total Percent Identity:          100.00
Gaps:                                 0
Alignment:

1   MGPWSRSLSALLLLLQVSSWLCQEPEPCHPGFDAESYTFTVPRRHLERGR   50
      ||||||||||||||||||||||||||||||||||||||||||||||||||
  1   MGPWSRSLSALLLLLQVSSWLCQEPEPCHPGFDAESYTFTVPRRHLERGR   50

51   VLGRVNFEDCTGRQRTAYFSLDTRFKVGTDGVITVKRPLRFHNPQIHFLV  100
      ||||||||||||||||||||||||||||||||||||||||||||||||||
 51   VLGRVNFEDCTGRQRTAYFSLDTRFKVGTDGVITVKRPLRFHNPQIHFLV  100

101   YAWDSTYRKFSTKVTLNTVGHHHRPPPHQASVSGIQAELLTFPNSSPGLR  150
      ||||||||||||||||||||||||||||||||||||||||||||||||||
101   YAWDSTYRKFSTKVTLNTVGHHHRPPPHQASVSGIQAELLTFPNSSPGLR  150

151   RQKRDWVIPPISCPENEKGPFPKNLVQIKSNKDKEGKVFYSITGQGADTP  200
      ||||||||||||||||||||||||||||||||||||||||||||||||||
151   RQKRDWVIPPISCPENEKGPFPKNLVQIKSNKDKEGKVFYSITGQGADTP  200

201   PVGVFIIERETGWLKVTEPLDRERIATYTLFSHAVSSNGNAVEDPMEILI  250
      ||||||||||||||||||||||||||||||||||||||||||||||||||
201   PVGVFIIERETGWLKVTEPLDRERIATYTLFSHAVSSNGNAVEDPMEILI  250

251   TVTDQNDNKPEFTQEVFKGSVMEGALPGTSVMEVTATDADDDVNTYNAAI  300
      ||||||||||||||||||||||||||||||||||||||||||||||||||
251   TVTDQNDNKPEFTQEVFKGSVMEGALPGTSVMEVTATDADDDVNTYNAAI  300

301   AYTILSQDPELPDKNMFTINRNTGVISVVTTGLDRE               336
      |||||||||||||||||||||||||||||||||||
301   AYTILSQDPELPDKNMFTINRNTGVISVVTTGLDRE               336

Sequence name: /tmp/rMRrwmuokD/1rmk2jOfgw:Q9UII7
Sequence documentation:
Alignment of: HSECADH_P15 (SEQ ID NO:330) x Q9UII7 . . .
Alignment segment 1/1:
Quality:                        2289.00
Escore:                               0
Matching length:                    229
Total length:                       229
Matching Percent Similarity:     100.00
Matching Percent Identity:       100.00
Total Percent Similarity:        100.00
Total Percent Identity:          100.00
Gaps:                                 0
Alignment:

1   MGPWSRSLSALLLLLQVSSWLCQEPEPCHPGFDAESYTFTVPRRHLERGR   50
      ||||||||||||||||||||||||||||||||||||||||||||||||||
  1   MGPWSRSLSALLLLLQVSSWLCQEPEPCHPGFDAESYTFTVPRRHLERGR   50

51   VLGRVNFEDCTGRQRTAYFSLDTRFKVGTDGVITVKRPLRFHNPQIHFLV  100
      ||||||||||||||||||||||||||||||||||||||||||||||||||
 51   VLGRVNFEDCTGRQRTAYFSLDTRFKVGTDGVITVKRPLRFHNPQIHFLV  100

101   YAWDSTYRKFSTKVTLNTVGHHHRPPPHQASVSGIQAELLTFPNSSPGLR  150
      ||||||||||||||||||||||||||||||||||||||||||||||||||
101   YAWDSTYRKFSTKVTLNTVGHHHRPPPHQASVSGIQAELLTFPNSSPGLR  150

151   RQKRDWVIPPISCPENEKGPFPKNLVQIKSNKDKEGKVFYSITGQGADTP  200
      ||||||||||||||||||||||||||||||||||||||||||||||||||
151   RQKRDWVIPPISCPENEKGPFPKNLVQIKSNKDKEGKVFYSITGQGADTP  200
```

```
  201 PVGVFIIERETGWLKVTEPLDRERIATYT                  229
      ||||||||||||||||||||||||||||
  201 PVGVFIIERETGWLKVTEPLDRERIATYT                  229
```

Sequence name: /tmp/rMRrwmuokD/1rmk2jOfgw:Q9UII8
Sequence documentation:
Alignment of: HSECADH_P15 (SEQ ID NO:330) x Q9UII8 . . .
Alignment segment 1/1:
Quality:                           2289.00
Escore:                                  0
Matching length:                       229
Total length:                          229
Matching Percent Similarity:        100.00
Matching Percent Identity:          100.00
Total Percent Similarity:           100.00
Total Percent Identity:             100.00
Gaps:                                    0
Alignment:

```
    1 MGPWSRSLSALLLLLQVSSWLCQEPEPCHPGFDAESYTFTVPRRHLERGR    50
      ||||||||||||||||||||||||||||||||||||||||||||||||||
    1 MGPWSRSLSALLLLLQVSSWLCQEPEPCHPGFDAESYTFTVPRRHLERGR    50

51 VLGRVNFEDCTGRQRTAYFSLDTRFKVGTDGVITVKRPLRFHNPQIHFLV   100
      ||||||||||||||||||||||||||||||||||||||||||||||||||
   51 VLGRVNFEDCTGRQRTAYFSLDTRFKVGTDGVITVKRPLRFHNPQIHFLV   100

101 YAWDSTYRKFSTKVTLNTVGHHHRPPPHQASVSGIQAELLTFPNSSPGLR   150
      ||||||||||||||||||||||||||||||||||||||||||||||||||
  101 YAWDSTYRKFSTKVTLNTVGHHHRPPPHQASVSGIQAELLTFPNSSPGLR   150

151 RQKRDWVIPPISCPENEKGPFPKNLVQIKSNKDKEGKVFYSITGQGADTP   200
      ||||||||||||||||||||||||||||||||||||||||||||||||||
  151 RQKRDWVIPPISCPENEKGPFPKNLVQIKSNKDKEGKVFYSITGQGADTP   200

201 PVGVFIIERETGWLKVTEPLDRERIATYT                       229
      ||||||||||||||||||||||||||||
  201 PVGVFIIERETGWLKVTEPLDRERIATYT                       229
```

Sequence name: /tmp/rMRrwmuokD/1rmk2jOfgw:CAD1_HUMAN
Sequence documentation:
Alignment of: HSECADH_P15 (SEQ ID NO:330) x CAD1_HUMAN . . .
Alignment segment 1/1:
Quality:                           2289.00
Escore:                                  0
Matching length:                       229
Total length:                          229
Matching Percent Similarity:        100.00
Matching Percent Identity:          100.00
Total Percent Similarity:           100.00
Total Percent Identity:             100.00
Gaps:                                    0
Alignment:

```
    1 MGPWSRSLSALLLLLQVSSWLCQEPEPCHPGFDAESYTFTVPRRHLERGR    50
      ||||||||||||||||||||||||||||||||||||||||||||||||||
    1 MGPWSRSLSALLLLLQVSSWLCQEPEPCHPGFDAESYTFTVPRRHLERGR    50
```

```
 51  VLGRVNFEDCTGRQRTAYFSLDTRFKVGTDGVITVKRPLRFHNPQIHFLV  100
     ||||||||||||||||||||||||||||||||||||||||||||||||||
 51  VLGRVNFEDCTGRQRTAYFSLDTRFKVGTDGVITVKRPLRFHNPQIHFLV  100

101  YAWDSTYRKFSTKVTLNTVGHHHRPPPHQASVSGIQAELLTFPNSSPGLR  150
     ||||||||||||||||||||||||||||||||||||||||||||||||||
101  YAWDSTYRKFSTKVTLNTVGHHHRPPPHQASVSGIQAELLTFPNSSPGLR  150

151  RQKRDWVIPPISCPENEKGPFPKNLVQIKSNKDKEGKVFYSITGQGADTP  200
     ||||||||||||||||||||||||||||||||||||||||||||||||||
151  RQKRDWVIPPISCPENEKGPFPKNLVQIKSNKDKEGKVFYSITGQGADTP  200

201  PVGVFIIERETGWLKVTEPLDRERIATYT  229
     |||||||||||||||||||||||||||||
201  PVGVFIIERETGWLKVTEPLDRERIATYT  229
```

Description for Cluster R11723

Cluster R11723 features 6 transcript(s) and 26 segment(s) of interest, the names for which are given in Tables 48 and 49, respectively, the sequences themselves are given at the end of the application. The selected protein variants are given in table 50.

TABLE 48

Transcripts of interest

| Transcript Name | Sequence ID No. |
| --- | --- |
| R11723_PEA_1_T15 | 5 |
| R11723_PEA_1_T17 | 6 |
| R11723_PEA_1_T19 | 7 |
| R11723_PEA_1_T20 | 8 |
| R11723_PEA_1_T5 | 9 |
| R11723_PEA_1_T6 | 10 |

TABLE 49

Segments of interest

| Segment Name | Sequence ID No. |
| --- | --- |
| R11723_PEA_1_node_13 | 90 |
| R11723_PEA_1_node_16 | 91 |
| R11723_PEA_1_node_19 | 92 |
| R11723_PEA_1_node_2 | 93 |
| R11723_PEA_1_node_22 | 94 |
| R11723_PEA_1_node_31 | 95 |
| R11723_PEA_1_node_10 | 96 |
| R11723_PEA_1_node_11 | 97 |
| R11723_PEA_1_node_15 | 98 |
| R11723_PEA_1_node_18 | 99 |
| R11723_PEA_1_node_20 | 100 |
| R11723_PEA_1_node_21 | 101 |
| R11723_PEA_1_node_23 | 102 |
| R11723_PEA_1_node_24 | 103 |
| R11723_PEA_1_node_25 | 104 |
| R11723_PEA_1_node_26 | 105 |
| R11723_PEA_1_node_27 | 106 |
| R11723_PEA_1_node_28 | 107 |
| R11723_PEA_1_node_29 | 108 |
| R11723_PEA_1_node_3 | 109 |
| R11723_PEA_1_node_30 | 110 |
| R11723_PEA_1_node_4 | 111 |
| R11723_PEA_1_node_5 | 112 |
| R11723_PEA_1_node_6 | 113 |

TABLE 49-continued

Segments of interest

| Segment Name | Sequence ID No. |
| --- | --- |
| R11723_PEA_1_node_7 | 114 |
| R11723_PEA_1_node_8 | 115 |

TABLE 50

Proteins of interest

| Protein Name | Sequence ID No. |
| --- | --- |
| R11723_PEA_1_P2 | 331 |
| R11723_PEA_1_P6 | 332 |
| R11723_PEA_1_P7 | 333 |
| R11723_PEA_1_P13 | 334 |
| R11723_PEA_1_P10 | 335 |

Cluster R11723 can be used as a diagnostic marker according to overexpression of transcripts of this cluster in cancer. Expression of such transcripts in normal tissues is also given according to the previously described methods. The term "number" in the right hand column of the table and the numbers on the y-axis of FIG. 7 refer to weighted expression of ESTs in each category, as "parts per million" (ratio of the expression of ESTs for a particular cluster to the expression of all ESTs in that category, according to parts per million).

Figure 7:
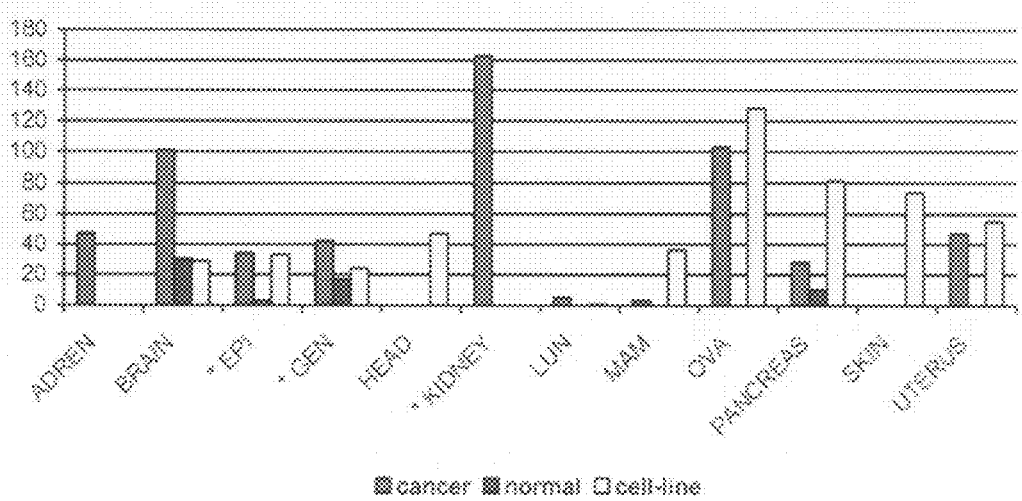
FIG. 7 is a histogram showing Cancer and cell-line vs. normal tissue expression for Cluster R11723, demonstrating overexpression in epithelial malignant tumors, a mixture of malignant tumors from different tissues and kidney malignant tumors.

Overall, the following results were obtained as shown with regard to the histograms in FIG. 7 and Table 51. This cluster is overexpressed (at least at a minimum level) in the following pathological conditions: epithelial malignant tumors, a mixture of malignant tumors from different tissues and kidney malignant tumors.

TABLE 51

Normal tissue distribution

| Name of Tissue | Number |
| --- | --- |
| Adrenal | 0 |
| Brain | 30 |
| Epithelial | 3 |

TABLE 51-continued

Normal tissue distribution

| Name of Tissue | Number |
| --- | --- |
| General | 17 |
| head and neck | 0 |
| Kidney | 0 |
| Lung | 0 |
| Breast | 0 |
| Ovary | 0 |
| Pancreas | 10 |
| Skin | 0 |
| Uterus | 0 |

TABLE 52

P values and ratios for expression in cancerous tissue

| Name of Tissue | P1 | P2 | SP1 | R3 | SP2 | R4 |
| --- | --- | --- | --- | --- | --- | --- |
| Adrenal | 4.2e−01 | 4.6e−01 | 4.6e−01 | 2.2 | 5.3e−01 | 1.9 |
| Brain | 2.2e−01 | 2.0e−01 | 1.2e−02 | 2.8 | 5.0e−02 | 2.0 |
| Epithelial | 3.0e−05 | 6.3e−05 | 1.8e−05 | 6.3 | 3.4e−06 | 6.4 |
| General | 7.2e−03 | 4.0e−02 | 1.3e−04 | 2.1 | 1.1e−03 | 1.7 |
| head and neck | 1 | 5.0e−01 | 1 | 1.0 | 7.5e−01 | 1.3 |
| Kidney | 1.5e−01 | 2.4e−01 | 4.4e−03 | 5.4 | 2.8e−02 | 3.6 |
| Lung | 1.2e−01 | 1.6e−01 | 1 | 1.6 | 1 | 1.3 |
| Breast | 5.9e−01 | 4.4e−01 | 1 | 1.1 | 6.8e−01 | 1.5 |
| Ovary | 1.6e−02 | 1.3e−02 | 1.0e−01 | 3.8 | 7.0e−02 | 3.5 |
| Pancreas | 5.5e−01 | 2.0e−01 | 3.9e−01 | 1.9 | 1.4e−01 | 2.7 |
| Skin | 1 | 4.4e−01 | 1 | 1.0 | 1.9e−02 | 2.1 |
| Uterus | 1.5e−02 | 5.4e−02 | 1.9e−01 | 3.1 | 1.4e−01 | 2.5 |

As noted above, cluster R11723 features 6 transcript(s), which were listed in Table 48 above. A description of each variant protein according to the present invention is now provided.

Variant protein R11723_PEA_1_P2 (SEQ ID NO:331) according to the present invention has an amino acid sequence as given at the end of the application; it is encoded by transcript(s) R11723_PEA_1_T6 (SEQ ID NO:10). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P2 (SEQ ID NO:331) also has the following non-silent SNPs (Single Nucleotide Polymorphisms) as listed in Table 53, (given according to their position(s) on the amino acid sequence, with the alternative amino acid(s) listed; the last column indicates whether the SNP is known or not; the presence of known SNPs in variant protein R11723_PEA_1_P2 (SEQ ID NO:331) sequence provides support for the deduced sequence of this variant protein according to the present invention).

TABLE 53

Amino acid mutations

| SNP position(s) on amino acid sequence | Alternative amino acid(s) | Previously known SNP? |
| --- | --- | --- |
| 107 | H -> P | Yes |
| 70 | G -> | No |
| 70 | G -> C | No |

Variant protein R11723_PEA_1_P2 (SEQ ID NO:331) is encoded by the following transcript(s): R11723_PEA_1_T6 (SEQ ID NO:10), for which the sequence(s) is/are given at the end of the application. The coding portion of transcript R11723_PEA_1_T6 (SEQ ID NO:10) is shown in bold; this coding portion starts at position 1716 and ends at position 2051. The transcript also has the following SNPs as listed in Table 54 (given according to their position on the nucleotide sequence, with the alternative nucleic acid listed; the last column indicates whether the SNP is known or not; the presence of known SNPs in variant protein R11723_PEA_1_P2 (SEQ ID NO:331) sequence provides support for the deduced sequence of this variant protein according to the present invention).

TABLE 54

Nucleic acid SNPs

| SNP position on nucleotide sequence | Alternative nucleic acid | Previously known SNP? |
| --- | --- | --- |
| 1231 | C -> T | Yes |
| 1278 | G -> C | Yes |
| 1923 | G -> | No |
| 1923 | G -> T | No |
| 2035 | A -> C | Yes |
| 2048 | A -> C | No |
| 2057 | A -> G | Yes |

Variant protein R11723_PEA_1_P6 (SEQ ID NO:332) according to the present invention has an amino acid sequence as given at the end of the application; it is encoded by transcript(s) R11723_PEA_1_T15 (SEQ ID NO:5). One or more alignments to one or more previously published protein sequences are given at the end of the application. A brief description of the relationship of the variant protein according to the present invention to each such aligned protein is as follows:

Comparison report between R11723_PEA_1_P6 (SEQ ID NO:332) and Q8IXM0 (SEQ ID NO:485):

1. An isolated chimeric polypeptide encoding for R11723_PEA_1_P6 (SEQ ID NO:332), comprising a first amino acid sequence being at least 70%, optionally at least 80%, preferably at least 85%, more preferably at least 90% and most preferably at least 95% homologous to a polypeptide having the sequence MWVLGIAATFCGLFLLPGFAL-QIQCYQCEEFQLNNDCSSPEFIVNCTVN-VQDMCQKEV MEQSAGIMYRKSCASSAACLIASAG-SPCRGLAPGREEQRALHKAGAVGGGVR (SEQ ID NO: 534) corresponding to amino acids 1-110 of R11723_PEA_1_P6 (SEQ ID NO:332), and MYAQALLVVGV-LQRQAAAQHLHEHPPKLLRGHRVQERVD-DRAEVEKRLREGEEDHV RPEVGPRPVVLGFGRSHDPPNLVGH-PAYGQCHNNQPWADTSRRERQRKEKHSMRTQ corresponding to amino acids 1-112 of Q8IXM0, which also corresponds to amino acids 111-222 of R11723_PEA_1_P6 (SEQ ID NO:332), wherein said first and second amino acid sequences are contiguous and in a sequential order.

2. An isolated polypeptide encoding for a head of R11723_PEA_1_P6 (SEQ ID NO:332), comprising a polypeptide being at least 70%, optionally at least about 80%, preferably at least about 85%, more preferably at least about 90% and most preferably at least about 95% homologous to the sequence MWVLGIAATFCGLFLLPGFAL-QIQCYQCEEFQLNNDCSSPEFIVNCTVN-VQDMCQKEV MEQSAGIMYRKSCASSAACLIASAG-SPCRGLAPGREEQRALHKAGAVGGGVR of (SEQ ID NO: 534) R11723_PEA_1_P6 (SEQ ID NO:332).

Comparison report between R11723_PEA_1_P6 (SEQ ID NO:332) and Q96AC2 (SEQ ID NO:486):

1. An isolated chimeric polypeptide encoding for R11723_PEA_1_P6 (SEQ ID NO:332), comprising a first amino acid sequence being at least 90% homologous to MWVLGIAATFCGLFLLPGFALQIQCYQ-CEEFQLNNDCSSPEFIVNCTVNVQDMCQKEV MEQSAGIMYRKSCASSAACLIASAG corresponding to amino acids 1-83 of Q96AC2, which also corresponds to amino acids 1-83 of R11723_PEA_1_P6 (SEQ ID NO:332), and a second amino acid sequence being at least 70%, optionally at least 80%, preferably at least 85%, more preferably at least 90% and most preferably at least 95% homologous to a polypeptide having the sequence SPCR-GLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO: 535) corresponding to amino acids 84-222 of R11723_PEA_1_P6 (SEQ ID NO:332), wherein said first and second amino acid sequences are contiguous and in a sequential order.

2. An isolated polypeptide encoding for a tail of R11723_PEA_1_P6 (SEQ ID NO:332), comprising a polypeptide being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO: 535) in R11723_PEA_1_P6 (SEQ ID NO:332).

Comparison report between R11723_PEA_1_P6 (SEQ ID NO:332) and Q8N2G4 (SEQ ID NO:487):

1. An isolated chimeric polypeptide encoding for R11723_PEA_1_P6 (SEQ ID NO:332), comprising a first amino acid sequence being at least 90% homologous to MWVLGIAATFCGLFLLPGFALQIQCYQ-CEEFQLNNDCSSPEFIVNCTVNVQDMCQKEV MEQSAGIMYRKSCASSAACLIASAG corresponding to amino acids 1-83 of Q8N2G4, which also corresponds to amino acids 1-83 of R11723_PEA_1_P6 (SEQ ID NO:332), and a second amino acid sequence being at least 70%, optionally at least 80%, preferably at least 85%, more preferably at least 90% and most preferably at least 95% homologous to a polypeptide having the sequence SPCR-GLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO: 535) corresponding to amino acids 84-222 of R11723_PEA_1_P6 (SEQ ID NO:332), wherein said first and second amino acid sequences are contiguous and in a sequential order.

2. An isolated polypeptide encoding for a tail of R11723_PEA_1_P6 (SEQ ID NO:332), comprising a polypeptide being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO: 535) in R11723_PEA_1_P6 (SEQ ID NO:332).

Comparison report between R11723_PEA_1_P6 (SEQ ID NO:332) and BAC85518 (SEQ ID NO:488):

1. An isolated chimeric polypeptide encoding for R11723_PEA_1_P6 (SEQ ID NO:332), comprising a first amino acid sequence being at least 90% homologous to MWVLGIAATFCGLFLLPGFALQIQCYQ-CEEFQLNNDCSSPEFIVNCTVNVQDMCQKEV MEQSAGIMYRKSCASSAACLIASAG corresponding to amino acids 24-106 of BAC85518, which also corresponds to amino acids 1-83 of R11723_PEA_1_P6 (SEQ ID NO:332), and a second amino acid sequence being at least 70%, optionally at least 80%, preferably at least 85%, more preferably at least 90% and most preferably at least 95% homologous to a polypeptide having the sequence SPCR-GLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO: 535) corresponding to amino acids 84-222 of R11723_PEA_1_P6 (SEQ ID NO:332), wherein said first and second amino acid sequences are contiguous and in a sequential order.

2. An isolated polypeptide encoding for a tail of R11723_PEA_1_P6 (SEQ ID NO:332), comprising a polypeptide being at least 70%, optionally at least about 80%, preferably at least about 85%, more preferably at least about 90% and most preferably at least about 95% homologous to the sequence SPCRGLAPGREEQRALHKAGA-VGGGVRMYAQALLVVGVLQRQAAAQHLHEHPPKLL RGHRVQERVDDRAEVEKRLREGEEDH-VRPEVGPRPVVLGFGRSHDPPNLVGHPAYGQ CHNNQPWADTSRRERQRKEKHSMRTQ (SEQ ID NO: 535) in R11723_PEA_1_P6 (SEQ ID NO:332).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P6 (SEQ ID NO:332) also has the following non-silent SNPs (Single Nucleotide Polymorphisms) as listed in Table 55, (given according to their position(s) on the amino acid sequence, with the alternative amino acid(s) listed; the last column indicates whether the SNP is known or not; the presence of known SNPs in variant protein R11723_PEA_1_P6 (SEQ ID NO:332) sequence provides support for the deduced sequence of this variant protein according to the present invention).

TABLE 55

Amino acid mutations

| SNP position(s) on amino acid sequence | Alternative amino acid(s) | Previously known SNP? |
|---|---|---|
| 180 | G -> | No |
| 180 | G -> C | No |
| 217 | H -> P | Yes |

Variant protein R11723_PEA_1_P6 (SEQ ID NO:332) is encoded by the following transcript(s): R11723_PEA_1_T15 (SEQ ID NO:5), for which the sequence(s) is/are given at the end of the application. The coding portion of transcript R11723_PEA_1_T15 (SEQ ID NO:5) is shown in bold; this coding portion starts at position 434 and ends at position 1099. The transcript also has the following SNPs as listed in Table 56 (given according to their position on the nucleotide sequence, with the alternative nucleic acid listed; the last column indicates whether the SNP is known or not; the presence of known SNPs in variant protein R11723_PEA_1_P6 (SEQ ID NO:332) sequence provides support for the deduced sequence of this variant protein according to the present invention).

TABLE 56

Nucleic acid SNPs

| SNP position on nucleotide sequence | Alternative nucleic acid | Previously known SNP? |
|---|---|---|
| 971 | G -> | No |
| 971 | G -> T | No |
| 1083 | A -> C | Yes |
| 1096 | A -> C | No |
| 1105 | A -> G | Yes |

Variant protein R11723_PEA_1_P7 (SEQ ID NO:333) according to the present invention has an amino acid sequence as given at the end of the application; it is encoded by transcript(s) R11723_PEA_1_T17 (SEQ ID NO:6). One or more alignments to one or more previously published protein sequences are given at the end of the application. A brief description of the relationship of the variant protein according to the present invention to each such aligned protein is as follows:

Comparison report between R11723_PEA_1_P7 (SEQ ID NO:333) and Q96AC2:

1. An isolated chimeric polypeptide encoding for R11723_PEA_1_P7 (SEQ ID NO:333), comprising a first amino acid sequence being at least 90% homologous to MWVLGIAATFCGLFLLPGFALQIQCYQ-CEEFQLNNDCSSPEFIVNCTVNVQDMCQKEV MEQSAG corresponding to amino acids 1-64 of Q96AC2, which also corresponds to amino acids 1-64 of R11723_PEA_1_P7 (SEQ ID NO:333), and a second amino acid sequence being at least 70%, optionally at least 80%, preferably at least 85%, more preferably at least 90% and most preferably at least 95% homologous to a polypeptide having the sequence SHCVTRLECSGTISAHCNLCLPG-SNDHPT (SEQ ID NO: 536) corresponding to amino acids 65-93 of R11723_PEA_1_P7 (SEQ ID NO:333), wherein said first and second amino acid sequences are contiguous and in a sequential order.

2. An isolated polypeptide encoding for a tail of R11723_PEA_1_P7 (SEQ ID NO:333), comprising a polypeptide being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO: 536) in R11723_PEA_1_P7 (SEQ ID NO:333).

Comparison report between R11723_PEA_1_P7 (SEQ ID NO:333) and Q8N2G4:

1. An isolated chimeric polypeptide encoding for R11723_PEA_1_P7 (SEQ ID NO:333), comprising a first amino acid sequence being at least 90% homologous to MWVLGIAATFCGLFLLPGFALQIQCYQ-CEEFQLNNDCSSPEFIVNCTVNVQDMCQKEV MEQSAG corresponding to amino acids 1-64 of Q8N2G4, which also corresponds to amino acids 1-64 of R11723_PEA_1_P7 (SEQ ID NO:333), and a second amino acid sequence being at least 70%, optionally at least 80%, preferably at least 85%, more preferably at least 90% and most preferably at least 95% homologous to a polypeptide having the sequence SHCVTRLECSGTISAHCNLCLPG-SNDHPT (SEQ ID NO: 536) corresponding to amino acids 65-93 of R11723_PEA_1_P7 (SEQ ID NO:333), wherein said first and second amino acid sequences are contiguous and in a sequential order.

2. An isolated polypeptide encoding for a tail of R11723_PEA_1_P7 (SEQ ID NO:333), comprising a polypeptide being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO: 536) in R11723_PEA_1_P7 (SEQ ID NO:333).

Comparison report between R11723_PEA_1_P7 (SEQ ID NO:333) and BAC85273 (SEQ ID NO:489):

1. An isolated chimeric polypeptide encoding for R11723_PEA_1_P7 (SEQ ID NO:333), comprising a first amino acid sequence being at least 70%, optionally at least 80%, preferably at least 85%, more preferably at least 90% and most preferably at least 95% homologous to a polypeptide having the sequence MWVLG (SEQ ID NO: 537) corresponding to amino acids 1-5 of R11723_PEA_1_P7 (SEQ ID NO:333), second amino acid sequence being at least 90% homologous to IAATFCGLFLLPGFALQIQ-CYQCEEFQLNNDCSSPEFIVNCTVNVQD-MCQKEVMEQSAG corresponding to amino acids 22-80 of BAC85273, which also corresponds to amino acids 6-64 of R11723_PEA_1_P7 (SEQ ID NO:333), and a third amino acid sequence being at least 70%, optionally at least 80%, preferably at least 85%, more preferably at least 90% and most preferably at least 95% homologous to a polypeptide having the sequence SHCVTRLECSGTISAHCNLCLPG-SNDHPT (SEQ ID NO: 536) corresponding to amino acids 65-93 of R11723_PEA_1_P7 (SEQ ID NO:333), wherein said first, second and third amino acid sequences are contiguous and in a sequential order.

2. An isolated polypeptide encoding for a head of R11723_PEA_1_P7 (SEQ ID NO:333), comprising a polypeptide being at least 70%, optionally at least about 80%, preferably at least about 85%, more preferably at least about 90% and most preferably at least about 95% homologous to the sequence MWVLG (SEQ ID NO: 537) of R11723_PEA_1_P7 (SEQ ID NO:333).

3. An isolated polypeptide encoding for a tail of R11723_PEA_1_P7 (SEQ ID NO:333), comprising a polypeptide being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO: 536) in R11723_PEA_1_P7 (SEQ ID NO:333).

Comparison report between R11723_PEA_1_P7 (SEQ ID NO:333) and BAC85518:

1. An isolated chimeric polypeptide encoding for R11723_PEA_1_P7 (SEQ ID NO:333), comprising a first amino acid sequence being at least 90% homologous to MWVLGIAATFCGLFLLPGFALQIQCYQ-CEEFQLNNDCSSPEFIVNCTVNVQDMCQKEV MEQSAG corresponding to amino acids 24-87 of BAC85518, which also corresponds to amino acids 1-64 of R11723_PEA_1_P7 (SEQ ID NO:333), and a second amino acid sequence being at least 70%, optionally at least 80%, preferably at least 85%, more preferably at least 90% and most preferably at least 95% homologous to a polypeptide having the sequence SHCVTRLECSGTISAHCNLCLPG-SNDHPT (SEQ ID NO: 536) corresponding to amino acids 65-93 of R11723_PEA_1_P7 (SEQ ID NO:333), wherein said first and second amino acid sequences are contiguous and in a sequential order.

2. An isolated polypeptide encoding for a tail of R11723_PEA_1_P7 (SEQ ID NO:333), comprising a polypeptide being at least 70%, optionally at least about 80%, preferably at least about 85%, more preferably at least about 90% and most preferably at least about 95% homologous to the sequence SHCVTRLECSGTISAHCNLCLPG-SNDHPT (SEQ ID NO: 536) in R11723_PEA_1_P7 (SEQ ID NO:333).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P7 (SEQ ID NO:333) also has the following non-silent SNPs (Single Nucleotide Polymorphisms) as listed in Table 57, (given according to their position(s) on the amino acid sequence, with the alternative amino acid(s) listed; the last column indicates whether the SNP is known or not; the presence of known SNPs in variant protein R11723_PEA_1_P7 (SEQ ID NO:333) sequence provides support for the deduced sequence of this variant protein according to the present invention).

TABLE 57

Amino acid mutations

| SNP position(s) on amino acid sequence | Alternative amino acid(s) | Previously known SNP? |
|---|---|---|
| 67 | C -> S | Yes |

Variant protein R11723_PEA_1_P7 (SEQ ID NO:333) is encoded by the following transcript(s): R11723_PEA_1_T17 (SEQ ID NO:6), for which the sequence(s) is/are given at the end of the application. The coding portion of transcript R11723_PEA_1_T17 (SEQ ID NO:6) is shown in bold; this coding portion starts at position 434 and ends at position 712. The transcript also has the following SNPs as listed in Table 58 (given according to their position on the nucleotide sequence, with the alternative nucleic acid listed; the last column indicates whether the SNP is known or not; the presence of known SNPs in variant protein R11723_PEA_1_P7 (SEQ ID NO:333) sequence provides support for the deduced sequence of this variant protein according to the present invention).

TABLE 58

Nucleic acid SNPs

| SNP position on nucleotide sequence | Alternative nucleic acid | Previously known SNP? |
|---|---|---|
| 625 | G -> T | Yes |
| 633 | G -> C | Yes |
| 1303 | C -> T | Yes |

Variant protein R11723_PEA_1_P13 (SEQ ID NO:334) according to the present invention has an amino acid sequence as given at the end of the application; it is encoded by transcript(s) R11723_PEA_1_T19 (SEQ ID NO:7) and R11723_PEA_1_T5 (SEQ ID NO:9). One or more alignments to one or more previously published protein sequences are given at the end of the application. A brief description of the relationship of the variant protein according to the present invention to each such aligned protein is as follows:

Comparison report between R11723_PEA_1_P13 (SEQ ID NO:334) and Q96AC2:

1. An isolated chimeric polypeptide encoding for R11723_PEA_1_P13 (SEQ ID NO:334), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q96AC2, which also corresponds to amino acids 1-63 of R11723_PEA_1_P13 (SEQ ID NO:334), and a second amino acid sequence being at least 70%, optionally at least 80%, preferably at least 85%, more preferably at least 90% and most preferably at least 95% homologous to a polypeptide having the sequence DTKRTNTLLFEMRHFAKQLTT (SEQ ID NO: 538) corresponding to amino acids 64-84 of R11723_PEA_1_P13 (SEQ ID NO:334), wherein said first and second amino acid sequences are contiguous and in a sequential order.

2. An isolated polypeptide encoding for a tail of R11723_PEA_1_P13 (SEQ ID NO:334), comprising a polypeptide being at least 70%, optionally at least about 80%, preferably at least about 85%, more preferably at least about 90% and most preferably at least about 95% homologous to the sequence DTKRTNTLLFEMRHFAKQLTT (SEQ ID NO: 538) in R11723_PEA_1_P13 (SEQ ID NO:334).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_1_P13 (SEQ ID NO:334) is encoded by the following transcript(s): R11723_PEA_1_T19 (SEQ ID NO:7), for which the sequence(s) is/are given at the end of the application. The coding portion of transcript R11723_PEA_1_T19 (SEQ ID NO:7) is shown in bold; this coding portion starts at position 434 and ends at position 685. The transcript also has the following SNPs as listed in Table 59 (given according to their position on the nucleotide sequence, with the alternative nucleic acid listed; the last column indicates whether the SNP is known or not; the presence of known SNPs in variant protein R11723_PEA_1_P13 (SEQ ID NO:334) sequence provides support for the deduced sequence of this variant protein according to the present invention).

TABLE 59

Nucleic acid SNPs

| SNP position on nucleotide sequence | Alternative nucleic acid | Previously known SNP? |
|---|---|---|
| 778 | G -> T | Yes |
| 786 | G -> C | Yes |
| 1456 | C -> T | Yes |

Variant protein R11723_PEA_1_P10 (SEQ ID NO:335) according to the present invention has an amino acid sequence as given at the end of the application; it is encoded by transcript(s) R11723_PEA_1_T20 (SEQ ID NO:8). One or more alignments to one or more previously published protein sequences are given at the end of the application. A brief description of the relationship of the variant protein according to the present invention to each such aligned protein is as follows:

Comparison report between R11723_PEA_1_P10 (SEQ ID NO:335) and Q96AC2:

1. An isolated chimeric polypeptide encoding for R 11723_PEA_1_P10 (SEQ ID NO:335), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q96AC2, which also corresponds to amino acids 1-63 of R11723_PEA_1_P10 (SEQ ID NO:335), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQ-PLPPRLK (SEQ ID NO: 539) corresponding to amino acids 64-90 of R11723_PEA_1_P10 (SEQ ID NO:335), wherein said first and second amino acid sequences are contiguous and in a sequential order.

2. An isolated polypeptide encoding for a tail of R11723_PEA_1_P10 (SEQ ID NO:335), comprising a polypeptide being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO: 539) in R11723_PEA_1_P10 (SEQ ID NO:335).

Comparison report between R11723_PEA_1_P10 (SEQ ID NO:335) and Q8N2G4:

1. An isolated chimeric polypeptide encoding for R11723_PEA_1_P10 (SEQ ID NO:335), comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 1-63 of Q8N2G4, which also corresponds to amino acids 1-63 of R11723_PEA_1_P10 (SEQ ID NO:335), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQ-PLPPRLK (SEQ ID NO: 539) corresponding to amino acids 64-90 of R11723_PEA_1_P10 (SEQ ID NO:335), wherein said first and second amino acid sequences are contiguous and in a sequential order.

2. An isolated polypeptide encoding for a tail of R11723_PEA_1_P10 (SEQ ID NO:335), comprising a polypeptide being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO: 539) in R11723_PEA_1_P10(SEQ ID NO:335).

Comparison report between R11723_PEA_1_P10 (SEQ ID NO:335) and BAC85273:

1. An isolated chimeric polypeptide encoding for R11723_PEA_1_P10 (SEQ ID NO:335), comprising a first amino acid sequence being at least 70%, optionally at least 80%, preferably at least 85%, more preferably at least 90% and most preferably at least 95% homologous to a polypeptide having the sequence MWVLG (SEQ ID NO: 537) corresponding to amino acids 1-5 of R11723_PEA_1_P10 (SEQ ID NO:335), second amino acid sequence being at least 90% homologous to IAATFCGLFLLPGFALQIQ-CYQCEEFQLNNDCSSPEFIVNCTVNVQD-MCQKEVMEQSA corresponding to amino acids 22-79 of BAC85273, which also corresponds to amino acids 6-63 of R11723_PEA_1_P10 (SEQ ID NO:335), and a third amino acid sequence being at least 70%, optionally at least 80%, preferably at least 85%, more preferably at least 90% and most preferably at least 95% homologous to a polypeptide having the sequence DRVSLCHEAGVQWNNFSTLQPLP-PRLK (SEQ ID NO: 539) corresponding to amino acids 64-90 of R11723_PEA_1_P10 (SEQ ID NO:335), wherein said first, second and third amino acid sequences are contiguous and in a sequential order.

2. An isolated polypeptide encoding for a head of R11723_PEA_1_P10 (SEQ ID NO:335), comprising a polypeptide being at least 70%, optionally at least about 80%, preferably at least about 85%, more preferably at least about 90% and most preferably at least about 95% homologous to the sequence MWVLG (SEQ ID NO: 537) of R11723_PEA_1_P10 (SEQ ID NO:335).

3. An isolated polypeptide encoding for a tail of R11723_PEA_1_P10 (SEQ ID NO:335), comprising a polypeptide being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO: 539) in R11723_PEA_1_P10 (SEQ ID NO:335).

Comparison report between R11723_PEA_1_P10 (SEQ ID NO:335) and BAC85518:

1. An isolated chimeric polypeptide encoding for R11723_PEA_1_P10 (SEQ ID NO:335) comprising a first amino acid sequence being at least 90% homologous to MWVLGIAATFCGLFLLPGFALQIQCYQ-CEEFQLNNDCSSPEFIVNCTVNVQDMCQKEV MEQSA corresponding to amino acids 24-86 of BAC85518, which also corresponds to amino acids 1-63 of R11723_PEA_1_P10 (SEQ ID NO:335), and a second amino acid sequence being at least 70%, optionally at least 80%, preferably at least 85%, more preferably at least 90% and most preferably at least 95% homologous to a polypeptide having the sequence DRVSLCHEAGVQWNNFSTLQ-PLPPRLK (SEQ ID NO: 539) corresponding to amino acids 64-90 of R11723_PEA_1_P10 (SEQ ID NO:335), wherein said first and second amino acid sequences are contiguous and in a sequential order.

2. An isolated polypeptide encoding for a tail of R11723_PEA_1_P10 (SEQ ID NO:335), comprising a polypeptide being at least 70%, optionally at least about 80%, preferably at least about 85%, more preferably at least about 90% and most preferably at least about 95% homologous to the sequence DRVSLCHEAGVQWNNFSTLQPLP-PRLK (SEQ ID NO: 539) in R11723_PEA_1_P10 (SEQ ID NO:335).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein R11723_PEA_L_P10 (SEQ ID NO:335) also has the following non-silent SNPs (Single Nucleotide Polymorphisms) as listed in Table 60, (given according to their position(s) on the amino acid sequence, with the alternative amino acid(s) listed; the last column indicates whether the SNP is known or not; the presence of known SNPs in variant protein R11723_PEA_1_P10 (SEQ ID NO:335) sequence provides support for the deduced sequence of this variant protein according to the present invention).

TABLE 60

Amino acid mutations

| SNP position(s) on amino acid sequence | Alternative amino acid(s) | Previously known SNP? |
|---|---|---|
| 66 | V -> F | Yes |

Variant protein R11723_PEA_1_P10 (SEQ ID NO:335) is encoded by the following transcript(s): R11723_PEA_1_T20 (SEQ ID NO:8), for which the sequence(s) is/are given at the end of the application. The coding portion of transcript R11723_PEA_1_T20 (SEQ ID NO:8) is shown in bold; this coding portion starts at position 434 and ends at position 703. The transcript also has the following SNPs as listed in Table 61 (given according to their position on the nucleotide sequence, with the alternative nucleic acid listed; the last column indicates whether the SNP is known or not; the presence of known SNPs in variant protein R11723_PEA_1_P10 (SEQ ID NO:335) sequence provides support for the deduced sequence of this variant protein according to the present invention).

TABLE 61

Nucleic acid SNPs

| SNP position on nucleotide sequence | Alternative nucleic acid | Previously known SNP? |
|---|---|---|
| 629 | G -> T | Yes |
| 637 | G -> C | Yes |
| 1307 | C -> T | Yes |

As noted above, cluster R11723 features 26 segment(s), which were listed in Table 49 above and for which the sequence(s) are given at the end of the application. These segment(s) are portions of nucleic acid sequence(s) which are described herein separately because they are of particular interest. A description of each segment according to the present invention is now provided.

Segment cluster R11723_PEA_1_node_13 (SEQ ID NO:90) according to the present invention is supported by 5 libraries. The number of libraries was determined as previously described. This segment can be found in the following transcript(s): R11723_PEA_1_T19 (SEQ ID NO:7), R11723_PEA_1_T5 (SEQ ID NO:9) and R11723_PEA_1_T6 (SEQ ID NO:10). Table 62 below describes the starting and ending position of this segment on each transcript.

TABLE 62

Segment location on transcripts

| Transcript name | Segment starting position | Segment ending position |
|---|---|---|
| R11723_PEA_1_T19 (SEQ ID NO:7) | 624 | 776 |
| R11723_PEA_1_T5 (SEQ ID NO:9) | 624 | 776 |
| R11723_PEA_1_T6 (SEQ ID NO:10) | 658 | 810 |

Segment cluster R11723_PEA_1_node_16 (SEQ ID NO:91) according to the present invention is supported by 3 libraries. The number of libraries was determined as previously described. This segment can be found in the following transcript(s): R11723_PEA_1_T17 (SEQ ID NO:6), R11723_PEA_1_T19 (SEQ ID NO:7) and R11723_PEA_1_T20 (SEQ ID NO:8). Table 63 below describes the starting and ending position of this segment on each transcript.

TABLE 63

Segment location on transcripts

| Transcript name | Segment starting position | Segment ending position |
|---|---|---|
| R11723_PEA_1_T17 (SEQ ID NO:6) | 624 | 1367 |
| R11723_PEA_1_T19 (SEQ ID NO:7) | 777 | 1520 |
| R11723_PEA_1_T20 (SEQ ID NO:8) | 628 | 1371 |

Segment cluster R11723_PEA_1_node_19 (SEQ ID NO:92) according to the present invention is supported by 45 libraries. The number of libraries was determined as previously described. This segment can be found in the following transcript(s): R11723_PEA_1_T5 (SEQ ID NO:9) and R11723_PEA_1_T6 (SEQ ID NO:10). Table 64 below describes the starting and ending position of this segment on each transcript.

TABLE 64

Segment location on transcripts

| Transcript name | Segment starting position | Segment ending position |
|---|---|---|
| R11723_PEA_1_T5 (SEQ ID NO:9) | 835 | 1008 |
| R11723_PEA_1_T6 (SEQ ID NO:10) | 869 | 1042 |

Segment cluster R11723_PEA_1_node_2 (SEQ ID NO:93) according to the present invention is supported by 29 libraries. The number of libraries was determined as previously described. This segment can be found in the following transcript(s): R11723_PEA_1_T15 (SEQ ID NO:5), R11723_PEA_1_T17 (SEQ ID NO:6), R11723_PEA_1_T19 (SEQ ID NO:7), R11723_PEA_1_T20 (SEQ ID NO:8), R11723_PEA_1_T5 (SEQ ID NO:9) and R11723_PEA_1_T6 (SEQ ID NO:10). Table 65 below describes the starting and ending position of this segment on each transcript.

TABLE 65

Segment location on transcripts

| Transcript name | Segment starting position | Segment ending position |
|---|---|---|
| R11723_PEA_1_T15 (SEQ ID NO:5) | 1 | 309 |
| R11723_PEA_1_T17 (SEQ ID NO:6) | 1 | 309 |
| R11723_PEA_1_T19 (SEQ ID NO:7) | 1 | 309 |
| R11723_PEA_1_T20 (SEQ ID NO:8) | 1 | 309 |
| R11723_PEA_1_T5 (SEQ ID NO:9) | 1 | 309 |
| R11723_PEA_1_T6 (SEQ ID NO:10) | 1 | 309 |

Segment cluster R11723_PEA_1_node_22 (SEQ ID NO:94) according to the present invention is supported by 65 libraries. The number of libraries was determined as previously described. This segment can be found in the following transcript(s): R11723_PEA_1_T5 (SEQ ID NO:9) and R11723_PEA_1_T6 (SEQ ID NO:10). Table 66 below describes the starting and ending position of this segment on each transcript.

TABLE 66

Segment location on transcripts

| Transcript name | Segment starting position | Segment ending position |
|---|---|---|
| R11723_PEA_1_T5 (SEQ ID NO:9) | 1083 | 1569 |
| R11723_PEA_1_T6 (SEQ ID NO:10) | 1117 | 1603 |

Segment cluster R11723_PEA_1_node_31 (SEQ ID NO:95) according to the present invention is supported by 70 libraries. The number of libraries was determined as previously described. This segment can be found in the following transcript(s): R11723_PEA__T15 (SEQ ID NO:5), R11723_PEA_1_T5 (SEQ ID NO:9) and R11723_PEA_1_T6 (SEQ ID NO:10). Table 67 below describes the starting and ending position of this segment on each transcript (it should be noted that these transcripts show alternative polyadenylation).

TABLE 67

Segment location on transcripts

| Transcript name | Segment starting position | Segment ending position |
|---|---|---|
| R11723_PEA_1_T15 (SEQ ID NO:5) | 1060 | 1295 |
| R11723_PEA_1_T5 (SEQ ID NO:9) | 1978 | 2213 |
| R11723_PEA_1_T6 (SEQ ID NO:10) | 2012 | 2247 |

According to an optional embodiment of the present invention, short segments related to the above cluster are also provided. These segments are up to about 120 bp in length, and so are included in a separate description.

Segment cluster R11723_PEA_1_node_10 (SEQ ID NO:96) according to the present invention is supported by 38 libraries. The number of libraries was determined as previously described. This segment can be found in the following transcript(s): R11723_PEA_1_T15 (SEQ ID NO:5), R11723_PEA_1_T17 (SEQ ID NO:6), R11723_PEA_1_T19 (SEQ ID NO:7), R11723_PEA_1_T20 (SEQ ID NO:8), R11723_PEA_1_T5 (SEQ ID NO:9) and R11723_PEA_1_T6 (SEQ ID NO:10). Table 68 below describes the starting and ending position of this segment on each transcript.

TABLE 68

Segment location on transcripts

| Transcript name | Segment starting position | Segment ending position |
|---|---|---|
| R11723_PEA_1_T15 (SEQ ID NO:5) | 486 | 529 |
| R11723_PEA_1_T17 (SEQ ID NO:6) | 486 | 529 |
| R11723_PEA_1_T19 (SEQ ID NO:7) | 486 | 529 |
| R11723_PEA_1_T20 (SEQ ID NO:8) | 486 | 529 |
| R11723_PEA_1_T5 (SEQ ID NO:9) | 486 | 529 |
| R11723_PEA_1_T6 (SEQ ID NO:10) | 520 | 563 |

Segment cluster R11723_PEA_1_node_11 (SEQ ID NO:97) according to the present invention is supported by 42 libraries. The number of libraries was determined as previously described. This segment can be found in the following transcript(s): R11723_PEA_1_T15 (SEQ ID NO:5), R11723_PEA_1_T17 (SEQ ID NO:6), R11723_PEA_1_T19 (SEQ ID NO:7), R11723_PEA_1_T20 (SEQ ID NO:8), R11723_PEA_1_T5 (SEQ ID NO:9) and R11723_PEA_1_T6 (SEQ ID NO:10). Table 69 below describes the starting and ending position of this segment on each transcript.

TABLE 69

Segment location on transcripts

| Transcript name | Segment starting position | Segment ending position |
|---|---|---|
| R11723_PEA_1_T15 (SEQ ID NO:5) | 530 | 623 |
| R11723_PEA_1_T17 (SEQ ID NO:6) | 530 | 623 |
| R11723_PEA_1_T19 (SEQ ID NO:7) | 530 | 623 |
| R11723_PEA_1_T20 (SEQ ID NO:8) | 530 | 623 |
| R11723_PEA_1_T5 (SEQ ID NO:9) | 530 | 623 |
| R11723_PEA_1_T6 (SEQ ID NO:10) | 564 | 657 |

Segment cluster R11723_PEA_1_node_15 (SEQ ID NO:98) according to the present invention can be found in the following transcript(s): R11723_PEA_1_T20 (SEQ ID NO:8) Table 70 below describes the starting and ending position of this segment on each transcript.

TABLE 70

Segment location on transcripts

| Transcript name | Segment starting position | Segment ending position |
|---|---|---|
| R11723_PEA_1_T20 (SEQ ID NO:8) | 624 | 627 |

Segment cluster R11723_PEA_1_node_18 (SEQ ID NO:99) according to the present invention is supported by 40 libraries. The number of libraries was determined as previously described. This segment can be found in the following transcript(s): R11723_PEA_1_T15 (SEQ ID NO:5), R11723_PEA_1_T5 (SEQ ID NO:9) and R11723_PEA_1_T6 (SEQ ID NO:10). Table 71 below describes the starting and ending position of this segment on each transcript.

TABLE 72

Segment location on transcripts

| Transcript name | Segment starting position | Segment ending position |
|---|---|---|
| R11723_PEA_1_T15 (SEQ ID NO:5) | 624 | 681 |
| R11723_PEA_1_T5 (SEQ ID NO:9) | 777 | 834 |
| R11723_PEA_1_T6 (SEQ ID NO:10) | 811 | 868 |

Segment cluster R11723_PEA_1_node_20 (SEQ ID NO:100) according to the present invention can be found in the following transcript(s): R11723_PEA_1_T5 (SEQ ID NO:9) and R11723_PEA_1_T6 (SEQ ID NO:10). Table 73 below describes the starting and ending position of this segment on each transcript.

TABLE 73

Segment location on transcripts

| Transcript name | Segment starting position | Segment ending position |
|---|---|---|
| R11723_PEA_1_T5 (SEQ ID NO:9) | 1009 | 1019 |
| R11723_PEA_1_T6 (SEQ ID NO:10) | 1043 | 1053 |

Segment cluster R11723_PEA_1_node_21 (SEQ ID NO:101) according to the present invention is supported by 36 libraries. The number of libraries was determined as previously described. This segment can be found in the following transcript(s): R11723_PEA_1_T5 (SEQ ID NO:9) and R11723_PEA_1_T6 (SEQ ID NO:10). Table 74 below describes the starting and ending position of this segment on each transcript.

TABLE 74

Segment location on transcripts

| Transcript name | Segment starting position | Segment ending position |
|---|---|---|
| R11723_PEA_1_T5 (SEQ ID NO:9) | 1020 | 1082 |
| R11723_PEA_1_T6 (SEQ ID NO:10) | 1054 | 1116 |

Segment cluster R11723_PEA_1_node_23 (SEQ ID NO:102) according to the present invention is supported by 39 libraries. The number of libraries was determined as previously described. This segment can be found in the following transcript(s): R11723_PEA_1_T5 (SEQ ID NO:9) and R11723_PEA_1_T6 (SEQ ID NO:10). Table 75 below describes the starting and ending position of this segment on each transcript.

TABLE 75

Segment location on transcripts

| Transcript name | Segment starting position | Segment ending position |
|---|---|---|
| R11723_PEA_1_T5 (SEQ ID NO:9) | 1570 | 1599 |
| R11723_PEA_1_T6 (SEQ ID NO:10) | 1604 | 1633 |

Segment cluster R11723_PEA_1_node_24 (SEQ ID NO:103) according to the present invention is supported by 51 libraries. The number of libraries was determined as previously described. This segment can be found in the following transcript(s): R11723_PEA_1_T15 (SEQ ID NO:51, R11723_PEA_1_T5 (SEQ ID NO:9) and R11723_PEA_1T6 (SEQ ID NO:10). Table 76 below describes the starting and ending position of this segment on each transcript.

TABLE 76

Segment location on transcripts

| Transcript name | Segment starting position | Segment ending position |
|---|---|---|
| R11723_PEA_1_T15 (SEQ ID NO:5) | 682 | 765 |
| R11723_PEA_1_T5 (SEQ ID NO:9) | 1600 | 1683 |
| R11723_PEA_1_T6 (SEQ ID NO:10) | 1634 | 1717 |

Segment cluster R11723_PEA_1_node_25 (SEQ ID NO:104) according to the present invention is supported by 54 libraries. The number of libraries was determined as previously described. This segment can be found in the following transcript(s): R11723_PEA_1_T15 (SEQ ID NO:5), R11723_PEA_1_T5 (SEQ ID NO:9) and R11723_PEA_1_T6 (SEQ ID NO:10). Table 77 below describes the starting and ending position of this segment on each transcript.

TABLE 77

Segment location on transcripts

| Transcript name | Segment starting position | Segment ending position |
|---|---|---|
| R11723_PEA_1_T15 (SEQ ID NO:5) | 766 | 791 |
| R11723_PEA_1_T5 (SEQ ID NO:9) | 1684 | 1709 |
| R11723_PEA_1_T6 (SEQ ID NO:10) | 1718 | 1743 |

Segment cluster R11723_PEA_1_node_26 (SEQ ID NO:105) according to the present invention is supported by 62 libraries. The number of libraries was determined as previously described. This segment can be found in the following transcript(s): R11723_PEA_1_T15 (SEQ ID NO:5), R11723_PEA_1_T5 (SEQ ID NO:9) and R11723_PEA_1_T6 (SEQ ID NO:10). Table 78 below describes the starting and ending position of this segment on each transcript.

TABLE 78

Segment location on transcripts

| Transcript name | Segment starting position | Segment ending position |
|---|---|---|
| R11723_PEA_1_T15 (SEQ ID NO:5) | 792 | 904 |
| R11723_PEA_1_T5 (SEQ ID NO:9) | 1710 | 1822 |
| R11723_PEA_1_T6 (SEQ ID NO:10) | 1744 | 1856 |

Segment cluster R11723_PEA_1_node_27 (SEQ ID NO:106) according to the present invention is supported by 67 libraries. The number of libraries was determined as previously described. This segment can be found in the following transcript(s): R11723_PEA_1_T15 (SEQ ID NO:5), R11723_PEA_1_T5 (SEQ ID NO:9) and R11723_PEA_1_T6 (SEQ ID NO:10). Table 79 below describes the starting and ending position of this segment on each transcript.

TABLE 79

Segment location on transcripts

| Transcript name | Segment starting position | Segment ending position |
|---|---|---|
| R11723_PEA_1_T15 (SEQ ID NO:5) | 905 | 986 |
| R11723_PEA_1_T5 (SEQ ID NO:9) | 1823 | 1904 |
| R11723_PEA_1_T6 (SEQ ID NO:10) | 1857 | 1938 |

Segment cluster R11723_PEA_1_node_28 (SEQ ID NO:107) according to the present invention can be found in the following transcript(s): R11723_PEA_1_T15 (SEQ ID NO:5), R11723_PEA_1_T5 (SEQ ID NO:9) and R11723_PEA_1_T6 (SEQ ID NO:10). Table 80 below describes the starting and ending position of this segment on each transcript.

TABLE 80

Segment location on transcripts

| Transcript name | Segment starting position | Segment ending position |
|---|---|---|
| R11723_PEA_1_T15 (SEQ ID NO:5) | 987 | 1010 |
| R11723_PEA_1_T5 (SEQ ID NO:9) | 1905 | 1928 |
| R11723_PEA_1_T6 (SEQ ID NO:10) | 1939 | 1962 |

Segment cluster R11723_PEA_1_node_29 (SEQ ID NO:108) according to the present invention is supported by 69 libraries. The number of libraries was determined as previously described. This segment can be found in the following transcript(s): R11723_PEA_1_T15 (SEQ ID NO:5), R11723_PEA_1_T5 (SEQ ID NO:9) and R11723_PEA_1_T6 (SEQ ID NO:10). Table 81 below describes the starting and ending position of this segment on each transcript.

TABLE 81

Segment location on transcripts

| Transcript name | Segment starting position | Segment ending position |
|---|---|---|
| R11723_PEA_1_T15 (SEQ ID NO:5) | 1011 | 1038 |
| R11723_PEA_1_T5 (SEQ ID NO:9) | 1929 | 1956 |
| R11723_PEA_1_T6 (SEQ ID NO:10) | 1963 | 1990 |

Segment cluster R11723_PEA_1_node_3 (SEQ ID NO:109) according to the present invention can be found in the following transcript(s): R11723_PEA_1_T15 (SEQ ID NO:5), R11723_PEA_1_T17 (SEQ ID NO:6), R11723_PEA_1_T19 (SEQ ID NO:7), R11723_PEA_1_T20 (SEQ ID NO:8), R11723_PEA_1_T5 (SEQ ID NO:9) and R11723_PEA_1_T6 (SEQ ID NO:10). Table 82 below describes the starting and ending position of this segment on each transcript.

TABLE 82

Segment location on transcripts

| Transcript name | Segment starting position | Segment ending position |
| --- | --- | --- |
| R11723_PEA_1_T15 (SEQ ID NO:5) | 310 | 319 |
| R11723_PEA_1_T17 (SEQ ID NO:6) | 310 | 319 |
| R11723_PEA_1_T19 (SEQ ID NO:7) | 310 | 319 |
| R11723_PEA_1_T20 (SEQ ID NO:8) | 310 | 319 |
| R11723_PEA_1_T5 (SEQ ID NO:9) | 310 | 319 |
| R11723_PEA_1_T6 (SEQ ID NO:10) | 310 | 319 |

Segment cluster R11723_PEA_1_node_30 (SEQ ID NO:110) according to the present invention can be found in the following transcript(s): R11723_PEA_1_T15 (SEQ ID NO:5), R11723_PEA_1_T5 (SEQ ID NO:9) and R11723_PEA_1_T6 (SEQ ID NO:10). Table 83 below describes the starting and ending position of this segment on each transcript.

TABLE 83

Segment location on transcripts

| Transcript name | Segment starting position | Segment ending position |
| --- | --- | --- |
| R11723_PEA_1_T15 (SEQ ID NO:5) | 1039 | 1059 |
| R11723_PEA_1_T5 (SEQ ID NO:9) | 1957 | 1977 |
| R11723_PEA_1_T6 (SEQ ID NO:10) | 1991 | 2011 |

Segment cluster R11723_PEA_1_node_4 (SEQ ID NO:111) according to the present invention is supported by 25 libraries. The number of libraries was determined as previously described. This segment can be found in the following transcript(s): R11723_PEA_1_T15 (SEQ ID NO:5), R11723_PEA_1_T17 (SEQ ID NO:6), R11723_PEA_1_T19 (SEQ ID NO:7), R11723_PEA_1_T20 (SEQ ID NO:8), R11723_PEA_1_T5 (SEQ ID NO:9) and R11723_PEA_1_T6 (SEQ ID NO:10). Table 84 below describes the starting and ending position of this segment on each transcript.

TABLE 84

Segment location on transcripts

| Transcript name | Segment starting position | Segment ending position |
| --- | --- | --- |
| R11723_PEA_1_T15 (SEQ ID NO:5) | 320 | 371 |
| R11723_PEA_1_T17 (SEQ ID NO:6) | 320 | 371 |
| R11723_PEA_1_T19 (SEQ ID NO:7) | 320 | 371 |
| R11723_PEA_1_T20 (SEQ ID NO:8) | 320 | 371 |
| R11723_PEA_1_T5 (SEQ ID NO:9) | 320 | 371 |
| R11723_PEA_1_T6 (SEQ ID NO:10) | 320 | 371 |

Segment cluster R11723_PEA_1_node_5 (SEQ ID NO:112) according to the present invention is supported by 26 libraries. The number of libraries was determined as previously described. This segment can be found in the following transcript(s): R11723_PEA_1_T15 (SEQ ID NO:5), R11723_PEA_1_T17 (SEQ ID NO:6), R11723_PEA_1_T19 (SEQ ID NO:7), R11723_PEA_1_T20 (SEQ ID NO:8), R11723_PEA_1_T5 (SEQ ID NO:9) and R11723_PEA_1_T6 (SEQ ID NO:10). Table 84 below describes the starting and ending position of this segment on each transcript.

TABLE 85

Segment location on transcripts

| Transcript name | Segment starting position | Segment ending position |
| --- | --- | --- |
| R11723_PEA_1_T15 (SEQ ID NO:5) | 372 | 414 |
| R11723_PEA_1_T17 (SEQ ID NO:6) | 372 | 414 |
| R11723_PEA_1_T19 (SEQ ID NO:7) | 372 | 414 |
| R11723_PEA_1_T20 (SEQ ID NO:8) | 372 | 414 |
| R11723_PEA_1_T5 (SEQ ID NO:9) | 372 | 414 |
| R11723_PEA_1_T6 (SEQ ID NO:10) | 372 | 414 |

Segment cluster R11723_PEA_1_node_6 (SEQ ID NO:113) according to the present invention is supported by 27 libraries. The number of libraries was determined as previously described. This segment can be found in the following transcript(s): R11723_PEA_1_T15 (SEQ ID NO:5), R11723_PEA_1_T17 (SEQ ID NO:6), R11723_PEA_1_T19 (SEQ ID NO:7), R11723_PEA_1_T20 (SEQ ID NO:8), R11723_PEA_1_T5 (SEQ ID NO:9) and R11723_PEA_1_T6 (SEQ ID NO:10). Table 86 below describes the starting and ending position of this segment on each transcript.

TABLE 86

Segment location on transcripts

| Transcript name | Segment starting position | Segment ending position |
| --- | --- | --- |
| R11723_PEA_1_T15 (SEQ ID NO:5) | 415 | 446 |
| R11723_PEA_1_T17 (SEQ ID NO:6) | 415 | 446 |
| R11723_PEA_1_T19 (SEQ ID NO:7) | 415 | 446 |
| R11723_PEA_1_T20 (SEQ ID NO:8) | 415 | 446 |
| R11723_PEA_1_T5 (SEQ ID NO:9) | 415 | 446 |
| R11723_PEA_1_T6 (SEQ ID NO:10) | 415 | 446 |

Segment cluster R11723_PEA_1_node_7 (SEQ ID NO:114) according to the present invention is supported by 29 libraries. The number of libraries was determined as previously described. This segment can be found in the following transcript(s): R11723_PEA_1_T15 (SEQ ID NO:5), R11723_PEA_1_T17 (SEQ ID NO:6), R11723_PEA_1_T19 (SEQ ID NO:7), R11723_PEA_1_T20 (SEQ ID NO:8), R11723_PEA_1_T5 (SEQ ID NO:9) and R11723_PEA_1_T6 (SEQ ID NO:10). Table 87 below describes the starting and ending position of this segment on each transcript.

TABLE 87

Segment location on transcripts

| Transcript name | Segment starting position | Segment ending position |
|---|---|---|
| R11723_PEA_1_T15 (SEQ ID NO:5) | 447 | 485 |
| R11723_PEA_1_T17 (SEQ ID NO:6) | 447 | 485 |
| R11723_PEA_1_T19 (SEQ ID NO:7) | 447 | 485 |
| R11723_PEA_1_T20 (SEQ ID NO:8) | 447 | 485 |
| R11723_PEA_1_T5 (SEQ ID NO:9) | 447 | 485 |
| R11723_PEA_1_T6 (SEQ ID NO:10) | 447 | 485 |

Segment cluster R11723_PEA_1_node_8 (SEQ ID NO:115) according to the present invention is supported by 2 libraries. The number of libraries was determined as previously described. This segment can be found in the following transcript(s): R11723_PEA_1_T6 (SEQ ID NO:10). Table 88 below describes the starting and ending position of this segment on each transcript.

TABLE 88

Segment location on transcripts

| Transcript name | Segment starting position | Segment ending position |
|---|---|---|
| R11723_PEA_1_T6 (SEQ ID NO:10) | 486 | 519 |

It should be noted that the variants of this cluster are variants of the hypothetical protein PSEC0181 (referred to herein as "PSEC"). Furthermore, use of the known protein (WT protein) for detection of ovarian cancer, alone or in combination with one or more variants of this cluster and/or of any other cluster and/or of any known marker, also comprises an embodiment of the present invention. It should be noted that the nucleotide transcript sequence of known protein (PSEC, also referred to herein as the "wild type" or WT protein) features at least one SNP that appears to affect the coding region, in addition to certain silent SNPs. This SNP does not have an effect on the R11723_PEA_1_T5 (SEQ ID NO:9) splice variant sequence): "G->" resulting in a missing nucleotide (affects amino acids from position 91 onwards). The missing nucleotide creates a frame shift, resulting in a new protein. This SNP was not previously identified and is supported by 5 ESTs out of ~70 ESTs in this exon.

Variant Protein Alignment to the Previously Known Protein:

```
Sequence name: /tmp/gp6eQTLWqk/mFtjUpUzhb:Q8IXM0
Sequence documentation:
Alignment of: R11723_PEA_1_P6 (SEQ ID NO:332) x Q8IXM0 . . .
Alignment segment 1/1:
Quality:                            1128.00
Escore:                                   0
Matching length:                        112
Total length:                           112
Matching Percent Similarity:         100.00
Matching Percent Identity:           100.00
Total Percent Similarity:            100.00
Total Percent Identity:              100.00
Gaps:                                     0

Alignment:

111   MYAQALLVVGVLQRQAAAQHLHEHPPKLLRGHRVQERVDDRAEVEKRLRE    160
      ||||||||||||||||||||||||||||||||||||||||||||||||||
  1   MYAQALLVVGVLQRQAAAQHLHEHPPKLLRGHRVQERVDDRAEVEKRLRE     50

161   GEEDHVRPEVGPRPVVLGFGRSHDPPNLVGHPAYGQCHNNQPWADTSRRE    210
      ||||||||||||||||||||||||||||||||||||||||||||||||||
 51   GEEDHVRPEVGPRPVVLGFGRSHDPPNLVGHPAYGQCHNNQPWADTSRRE    100

211   RQRKEKHSMRTQ                                         222
      ||||||||||||
101   RQRKEKHSMRTQ                                         112

Sequence name: /tmp/gp6eQTLWqk/mFtjUpUzhb:Q96AC2
Sequence documentation:
Alignment of: R11723_PEA_1_P6 (SEQ ID NO:332) x Q96AC2 . . .
Alignment segment 1/1:
Quality:                             835.00
Escore:                                   0
Matching length:                         83
Total length:                            83
Matching Percent Similarity:         100.00
Matching Percent Identity:           100.00
Total Percent Similarity:            100.00
```

```
                                 -continued
Total Percent Identity:                       100.00
Gaps:                                              0

Alignment:
      •         •         •         •         •
  1   MWVLGIAATFCGLFLLPGFALQIQCYQCEEFQLNNDCSSPEFIVNCTVNV   50
      ||||||||||||||||||||||||||||||||||||||||||||||||||
  1   MWVLGIAATFCGLFLLPGFALQIQCYQCEEFQLNNDCSSPEFIVNCTVNV   50

•         •         •
 51   QDMCQKEVMEQSAGIMYRKSCASSAACLIASAG                   83
      ||||||||||||||||||||||||||||||||
 51   QDMCQKEVMEQSAGIMYRKSCASSAACLIASAG                   83

Sequence name: /tmp/gp6eQTLWqk/mFtjUpUzhb:Q8N2G4
Sequence documentation:
Alignment of: R11723_PEA_1_P6 (SEQ ID NO:332) x Q8N2G4 . . .
Alignment segment 1/1:
Quality:                                      835.00
Escore:                                            0
Matching length:                                  83
Total length:                                     83
Matching Percent Similarity:                  100.00
Matching Percent Identity:                    100.00
Total Percent Similarity:                     100.00
Total Percent Identity:                       100.00
Gaps:                                              0

Alignment:
      •         •         •         •         •
  1   MWVLGIAATFCGLFLLPGFALQIQCYQCEEFQLNNDCSSPEFIVNCTVNV   50
      ||||||||||||||||||||||||||||||||||||||||||||||||||
  1   MWVLGIAATFCGLFLLPGFALQIQCYQCEEFQLNNDCSSPEFIVNCTVNV   50

•         •         •
 51   QDMCQKEVMEQSAGIMYRKSCASSAACLIASAG                   83
      ||||||||||||||||||||||||||||||||
 51   QDMCQKEVMEQSAGIMYRKSCASSAACLIASAG                   83

Sequence name: /tmp/gp6eQTLWqk/mFtjUpUzhb:BAC85518
Sequence documentation:
Alignment of: R11723_PEA_1_P6 (SEQ ID NO:332) x BAC85518 . . .
Alignment segment 1/1:
Quality:                                      835.00
Escore:                                            0
Matching length:                                  83
Total length:                                     83
Matching Percent Similarity:                  100.00
Matching Percent Identity:                    100.00
Total Percent Similarity:                     100.00
Total Percent Identity:                       100.00
Gaps:                                              0

Alignment:
      •         •         •         •         •
  1   MWVLGIAATFCGLFLLPGFALQIQCYQCEEFQLNNDCSSPEFIVNCTVNV   50
      ||||||||||||||||||||||||||||||||||||||||||||||||||
 24   MWVLGIAATFCGLFLLPGFALQIQCYQCEEFQLNNDCSSPEFIVNCTVNV   73

•         •         •
 51   QDMCQKEVMEQSAGIMYRKSCASSAACLIASAG                   83
      ||||||||||||||||||||||||||||||||
 74   QDMCQKEVMEQSAGIMYRKSCASSAACLIASAG                  106

Sequence name: /tmp/VXjdFlzdBX/bexTxTh0Th:Q96AC2
Sequence documentation:
Alignment of: R11723_PEA_1_P7 (SEQ ID NO:333) x Q96AC2 . . .
Alignment segment 1/1:
Quality:                                      654.00
Escore:                                            0
Matching length:                                  64
Total length:                                     64
Matching Percent Similarity:                  100.00
Matching Percent Identity:                    100.00
Total Percent Similarity:                     100.00
Total Percent Identity:                       100.00
Gaps:                                              0

Alignment:
```

```
      .         .         .         .         .
  1   MWVLGIAATFCGLFLLPGFALQIQCYQCEEFQLNNDCSSPEFIVNCTVNV  50
      ||||||||||||||||||||||||||||||||||||||||||||||||||
  1   MWVLGIAATFCGLFLLPGFALQIQCYQCEEFQLNNDCSSPEFIVNCTVNV  50

.
 51   QDMCQKEVMEQSAG                                     64
      ||||||||||||||
 51   QDMCQKEVMEQSAG                                     64
```

Sequence name: /tmp/VXjdFlzdBX/bexTxTh0Th:Q8N2G4
Sequence documentation:
Alignment of: R11723_PEA_1_P7 (SEQ ID NO:333) x Q8N2G4 . . .
Alignment segment 1/1:
Quality:                             654.00
Escore:                                   0
Matching length:                         64
Total length:                            64
Matching Percent Similarity:         100.00
Matching Percent Identity:           100.00
Total Percent Similarity:            100.00
Total Percent Identity:              100.00
Gaps:                                     0

Alignment:

```
      .         .         .         .         .
  1   MWVLGIAATFCGLFLLPGFALQIQCYQCEEFQLNNDCSSPEFIVNCTVNV  50
      ||||||||||||||||||||||||||||||||||||||||||||||||||
  1   MWVLGIAATFCGLFLLPGFALQIQCYQCEEFQLNNDCSSPEFIVNCTVNV  50

.
 51   QDMCQKEVMEQSAG                                     64
      ||||||||||||||
 51   QDMCQKEVMEQSAG                                     64
```

Sequence name: /tmp/VXjdFlzdBX/bexTxTh0Th:BAC85273
Sequence documentation:
Alignment of: R11723_PEA_1_P7 (SEQ ID NO:333) x BAC85273 . . .
Alignment segment 1/1:
Quality:                             600.00
Escore:                                   0
Matching length:                         59
Total length:                            59
Matching Percent Similarity:         100.00
Matching Percent Identity:           100.00
Total Percent Similarity:            100.00
Total Percent Identity:              100.00
Gaps:                                     0

Alignment:

```
           .         .         .         .         .
  6   IAATFCGLFLLPGFALQIQCYQCEEFQLNNDCSSPEFIVNCTVNVQDMCQ  55
      |||||||||||||||||||||||||||||||||||||||||||||||||
 22   IAATFCGLFLLPGFALQIQCYQCEEFQLNNDCSSPEFIVNCTVNVQDMCQ  71

56   KEVMEQSAG                                          64
      |||||||||
 72   KEVMEQSAG                                          80
```

Sequence name: /tmp/VXjdFlzdBX/bexTxTh0Th:BAC85518
Sequence documentation:
Alignment of: R11723_PEA_1_P7 (SEQ ID NO:333) x BAC85518 . . .
Alignment segment 1/1:
Quality:                             654.00
Escore:                                   0
Matching length:                         64
Total length:                            64
Matching Percent Similarity:         100.00
Matching Percent Identity:           100.00
Total Percent Similarity:            100.00
Total Percent Identity:              100.00
Gaps:                                     0

Alignment:

```
      .         .         .         .         .
  1   MWVLGIAATFCGLFLLPGFALQIQCYQCEEFQLNNDCSSPEFIVNCTVNV  50
      ||||||||||||||||||||||||||||||||||||||||||||||||||
 24   MWVLGIAATFCGLFLLPGFALQIQCYQCEEFQLNNDCSSPEFIVNCTVNV  73
```

```
51  QDMCQKEVMEQSAG                                              64
    ||||||||||||||
74  QDMCQKEVMEQSAG                                              87

Sequence name: /tmp/OLMSexEmIh/pc7Z7Xm1YR:Q96AC2
Sequence documentation:
Alignment of: R11723_PEA_1_P10 (SEQ ID NO:335) x Q96AC2 . . .
Alignment segment 1/1:
Quality:                              645.00
Escore:                                    0
Matching length:                          63
Total length:                             63
Matching Percent Similarity:          100.00
Matching Percent Identity:            100.00
Total Percent Similarity:             100.00
Total Percent Identity:               100.00
Gaps:                                      0

Alignment:

1   MWVLGIAATFCGLFLLPGFALQIQCYQCEEFQLNNDCSSPEFIVNCTVNV           50
    ||||||||||||||||||||||||||||||||||||||||||||||||||
1   MWVLGIAATFCGLFLLPGFALQIQCYQCEEFQLNNDCSSPEFIVNCTVNV           50

51  QDMCQKEVMEQSA                                               63
    |||||||||||||
51  QDMCQKEVMEQSA                                               63

Sequence name: /tmp/OLMSexEmIh/pc7Z7Xm1YR:Q8N2G4
Sequence documentation:
Alignment of: R11723_PEA_1_P10 (SEQ ID NO:335) x Q8N2G4 . . .
Alignment segment 1/1:
Quality:                              645.00
Escore:                                    0
Matching length:                          63
Total length:                             63
Matching Percent Similarity:          100.00
Matching Percent Identity:            100.00
Total Percent Similarity:             100.00
Total Percent Identity:               100.00
Gaps:                                      0

Alignment:

1   MWVLGIAATFCGLFLLPGFALQIQCYQCEEFQLNNDCSSPEFIVNCTVNV           50
    ||||||||||||||||||||||||||||||||||||||||||||||||||
1   MWVLGIAATFCGLFLLPGFALQIQCYQCEEFQLNNDCSSPEFIVNCTVNV           50

51  QDMCQKEVMEQSA                                               63
    |||||||||||||
51  QDMCQKEVMEQSA                                               63

Sequence name: /tmp/OLMSexEmIh/pc7Z7Xm1YR:BAC85273
Sequence documentation:
Alignment of: R11723_PEA_1_P10 (SEQ ID NO:335) x BAC85273 . . .
Alignment segment 1/1:
Quality:                              591.00
Escore:                                    0
Matching length:                          58
Total length:                             58
Matching Percent Similarity:          100.00
Matching Percent Identity:            100.00
Total Percent Similarity:             100.00
Total Percent Identity:               100.00
Gaps:                                      0

Alignment:

6   IAATFCGLFLLPGFALQIQCYQCEEFQLNNDCSSPEFIVNCTVNVQDMCQ           55
    |||||||||||||||||||||||||||||||||||||||||||||||||
22  IAATFCGLFLLPGFALQIQCYQCEEFQLNNDCSSPEFIVNCTVNVQDMCQ           71

56  KEVMEQSA                                                    63
    ||||||||
72  KEVMEQSA                                                    79
```

```
-continued
Sequence name: /tmp/OLMSexEmIh/pc7Z7Xm1YR:BAC85518
Sequence documentation:
Alignment of: R11723_PEA_1_P10 (SEQ ID NO:335) x BAC85518 . . .
Alignment segment 1/1:
Quality:                                 645.00
Escore:                                       0
Matching length:                             63
Total length:                                63
Matching Percent Similarity:             100.00
Matching Percent Identity:               100.00
Total Percent Similarity:                100.00
Total Percent Identity:                  100.00
Gaps:                                         0

Alignment:
  1  MWVLGIAATFCGLFLLPGFALQIQCYQCEEFQLNNDCSSPEFIVNCTVNV  50
     |||||||||||||||||||||||||||||||||||||||||||||||||
 24  MWVLGIAATFCGLFLLPGFALQIQCYQCEEFQLNNDCSSPEFIVNCTVNV  73

51  QDMCQKEVMEQSA                                      63
     |||||||||||||
 74  QDMCQKEVMEQSA                                      86

Alignment of: R11723_PEA_1_P13 (SEQ ID NO:334) x Q96AC2 . . .
Alignment segment 1/1:
Quality:                                 645.00
Escore:                                       0
Matching length:                             63
Total length:                                63
Matching Percent Similarity:             100.00
Matching Percent Identity:               100.00
Total Percent Similarity:                100.00
Total Percent Identity:                  100.00
Gaps:                                         0

Alignment:
  1  MWVLGIAATFCGLFLLPGFALQIQCYQCEEFQLNNDCSSPEFIVNCTVNV  50
     |||||||||||||||||||||||||||||||||||||||||||||||||
  1  MWVLGIAATFCGLFLLPGFALQIQCYQCEEFQLNNDCSSPEFIVNCTVNV  50

51  QDMCQKEVMEQSA                                      63
     |||||||||||||
 51  QDMCQKEVMEQSA                                      63
```

Expression of R11723 Transcripts Which are Detectable by Amplicon as Depicted in Sequence Name R11723 seg13 in Normal and Cancerous Prostate Tissues Expression of transcripts detectable by or according to seg13, R11732seg13 (SEQ ID NO:492) amplicon_(s) and R11732seg13F (SEQ ID NO:490) and R11732seg13R (SEQ ID NO:491) primers was measured by real time PCR. In parallel the expression of four housekeeping genes—PBGD (GenBank Accession No. BC019323 (SEQ ID NO:509); amplicon—PBGD-amplicon, HPRT1 (GenBank Accession No. NM_000194 (SEQ ID NO:510); amplicon—HPRT1-amplicon (SEQ ID NO:401), SDHA (GenBank Accession No. NM_004168 (SEQ ID NO:508); amplicon—SDHA-, RPL19 (GenBank Accession No. NM_000981 (SEQ ID NO:511); RPL19 amplicon (SEQ ID NO:410) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 42,48-53,59-63, Table 1 above, "Tissue samples in testing panel"), to obtain a value of fold up-regulation for each sample relative to median of the normal PM samples.

Figure 8:
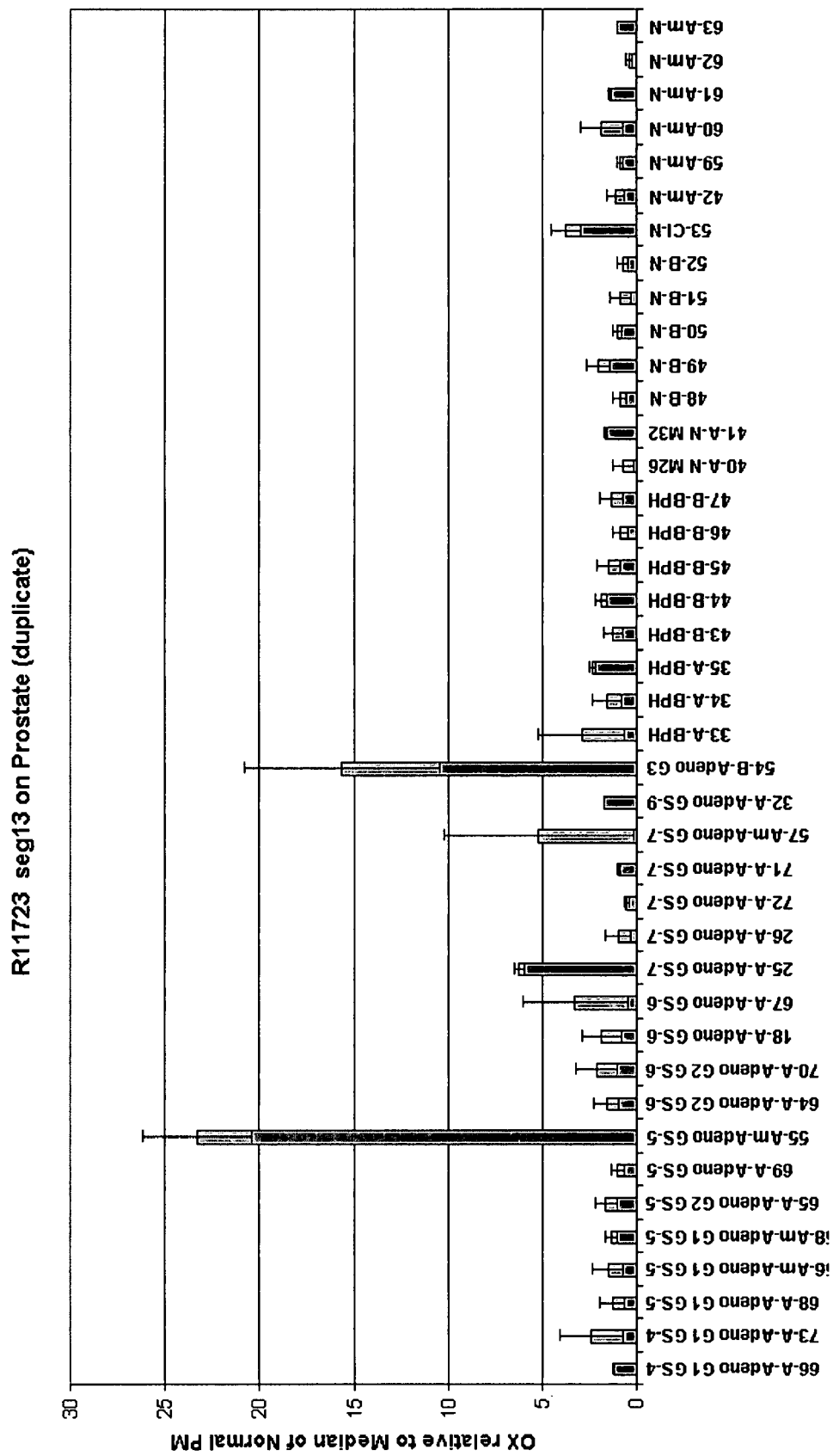
FIG. 8 is a histogram showing over expression of the R11723 transcripts which are detectable by amplicon as depicted in sequence name R11723 seg13 (SEQ ID NO:492) in cancerous prostate samples relative to the normal samples.

FIG. 8 is a histogram showing over expression of the above-indicated transcripts in cancerous prostate samples relative to the normal samples. Values represent the average of duplicate experiments. Error bars indicate the minimal and maximal values obtained).

As is evident from FIG. 8, the expression of transcripts detectable by the above amplicon in cancer samples was higher than in the non-cancerous samples (Sample Nos. 42,48-53,59-63, Table 1 above, "Tissue samples in testing panel"). Notably an over-expression of at least 5 fold was found in 4 out of 19 adenocarcinoma samples Statistical analysis was applied to verify the significance of these results, as described below.

The P value for the difference in the expression levels of transcripts detectable by the above amplicon_(s) in prostate cancer samples versus the normal tissue samples was determined by T test as 7.57E-02.

The above values demonstrate statistical significance of the results. Primer pairs are also optionally and preferably encompassed within the present invention; for example, for the above experiment, the following primer pair was used as a non-limiting illustrative example only of a suitable primer pair: R11732seg13F forward primer (SEQ ID NO:490); and R 11732seg13R reverse primer (SEQ ID NO:491).

The present invention also preferably encompasses any amplicon obtained through the use of any suitable primer pair; for example, for the above experiment, the following amplicon was obtained as a non-limiting illustrative example only of a suitable amplicon_: R11732seg13 (SEQ ID NO:492)

```
R11732seg13F (SEQ ID NO: 490)-
ACACTAAAAGAACAAACACCTTGCTC

R11732seg13R (SEQ ID NO: 491)-
TCCTCAGAAGGCACATGAAAGA

R11732seg13 (SEQ ID NO: 492) (SEQ ID NO: 492)-
ACACTAAAAGAACAAACACCTTGCTCTTCGAGATGAGACATTTTGCCAAG

CAGTTGACCACTTAGTTCTCAAGAAGCAACTATCTCTTTCATGTGCCTTC

TGAGGA
```

Expression of R11723 Transcripts Which are Detectable by Amplicon_as Depicted in Sequence Name R11723seg13 (SEQ ID NO:492) in Different Normal Tissues Expression of R11723 transcripts detectable by or according to R 11723seg13 (SEQ ID NO:492) amplicon and R11723seg13F (SEQ ID NO:490), R11723seg13R (SEQ ID NO:491) was measured by real time PCR. In parallel the expression of four housekeeping genes: RPL19 (GenBank Accession No. NM_000981 (SEQ ID NO:511); RPL19 amplicon (SEQ ID NO:410), TATA box (GenBank Accession No. NM_003194 (SEQ ID NO:512); TATA amplicon (SEQ ID NO:515), Ubiquitin (GenBank Accession No. BC000449 (SEQ ID NO:516); amplicon_-Ubiquitin-amplicon (SEQ ID NO:519)) and SDHA (GenBank Accession No. NM_004168 (SEQ ID NO:508); amplicon—SDHA-amplicon was measured similarly. For each RT sample, the expression of the above amplicon_was normalized to the geometric mean of the quantities of the housekeeping genes. The normalized quantity of each RT sample was then divided by the median of the quantities of the ovary samples (Sample Nos. 18-20 Table 2 "Tissue samples in normal panel", above), to obtain a value of relative expression of each sample relative to median of the ovary samples. Primers and amplicon are as above.

Figure 9:
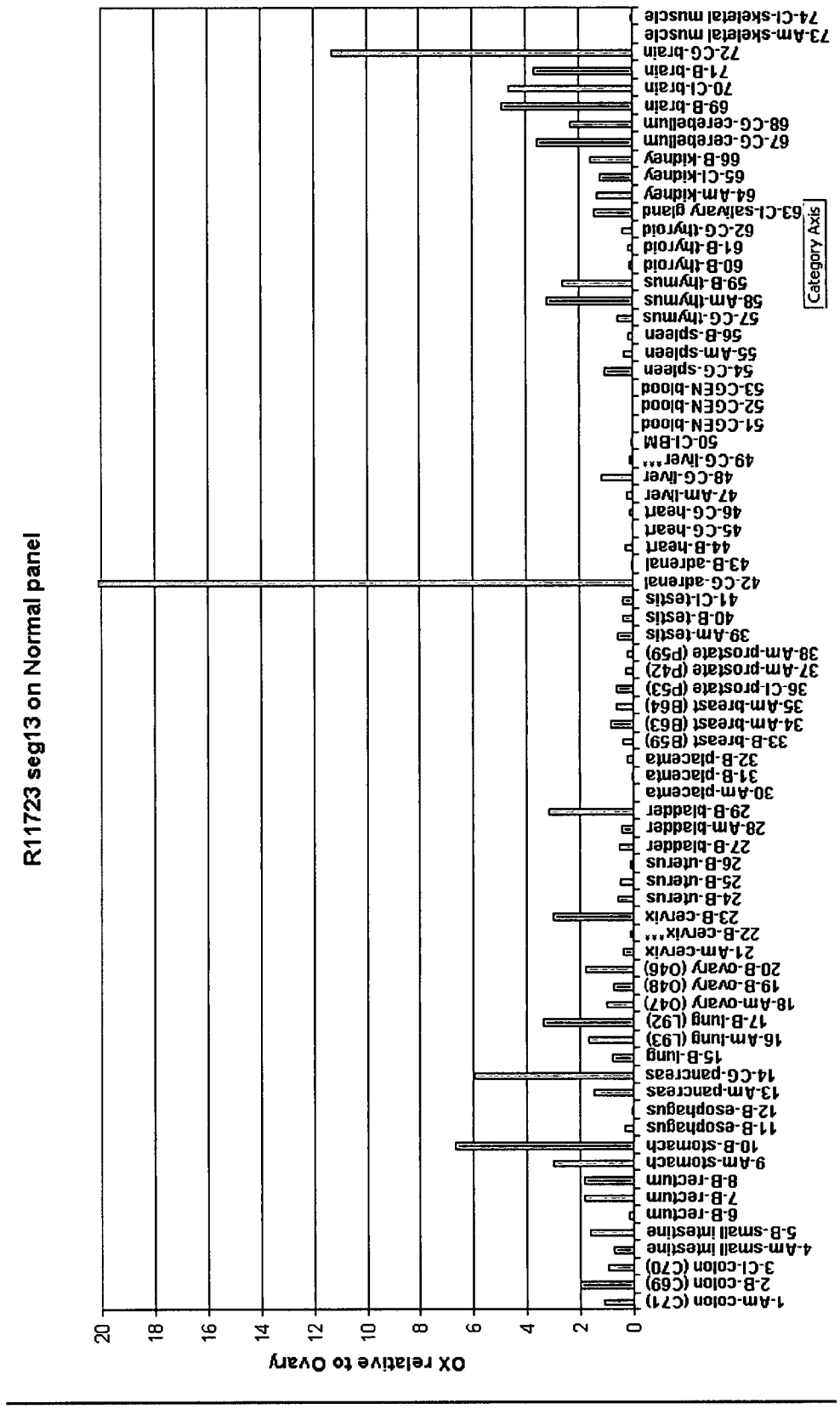
FIG. 9 is a histogram showing expression of R11723 transcripts, which are detectable by amplicon as depicted in sequence name R11723seg13 (SEQ ID NO:492), in different normal tissues.

The results are presented in FIG. 9, demonstrating the expression of R11723 transcripts which are detectable by amplicon as depicted in sequence name R11723seg13 (SEQ ID NO:492) in different normal tissues.

Expression of R11723 Transcripts, Which are Detectable by Amplicon as Depicted in Sequence Name R11723junc11-18 (SEQ ID NO:495) in Normal and Cancerous Prostate Tissues.

Expression of transcripts detectable by or according to junc11-18 R11732junc11-18 amplicon (SEQ ID NO:495) and R11732junc11-18F (SEQ ID NO:493) and R11732junc11-18R (SEQ ID NO:494) primers was measured by real time PCR (this junction is found in the known protein sequence or "wild type" (WT) sequence, also termed herein the PSEC sequence). In parallel the expression of four housekeeping genes—PBGD (GenBank Accession No. BC019323 (SEQ ID NO:509); amplicon=—PBGD-amplicon (SEQ ID NO:404)), HPRT1 (GenBank Accession No. NM_000194 (SEQ ID NO:510); amplicon_—HPRT1-amplicon (SEQ ID NO:401)), SDHA (GenBank Accession No. NM_004168 (SEQ ID NO:508); amplicon—SDHA-amplicon, and RPL19 (GenBank Accession No. NM_000981 (SEQ ID NO:511); RPL19 amplicon (SEQ ID NO:410) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 42,48-53,59-63 Table 1, above "Tissue samples in prostate cancer testing panel"), to obtain a value of fold up-regulation for each sample relative to median of the normal PM samples.

Figure 10A:
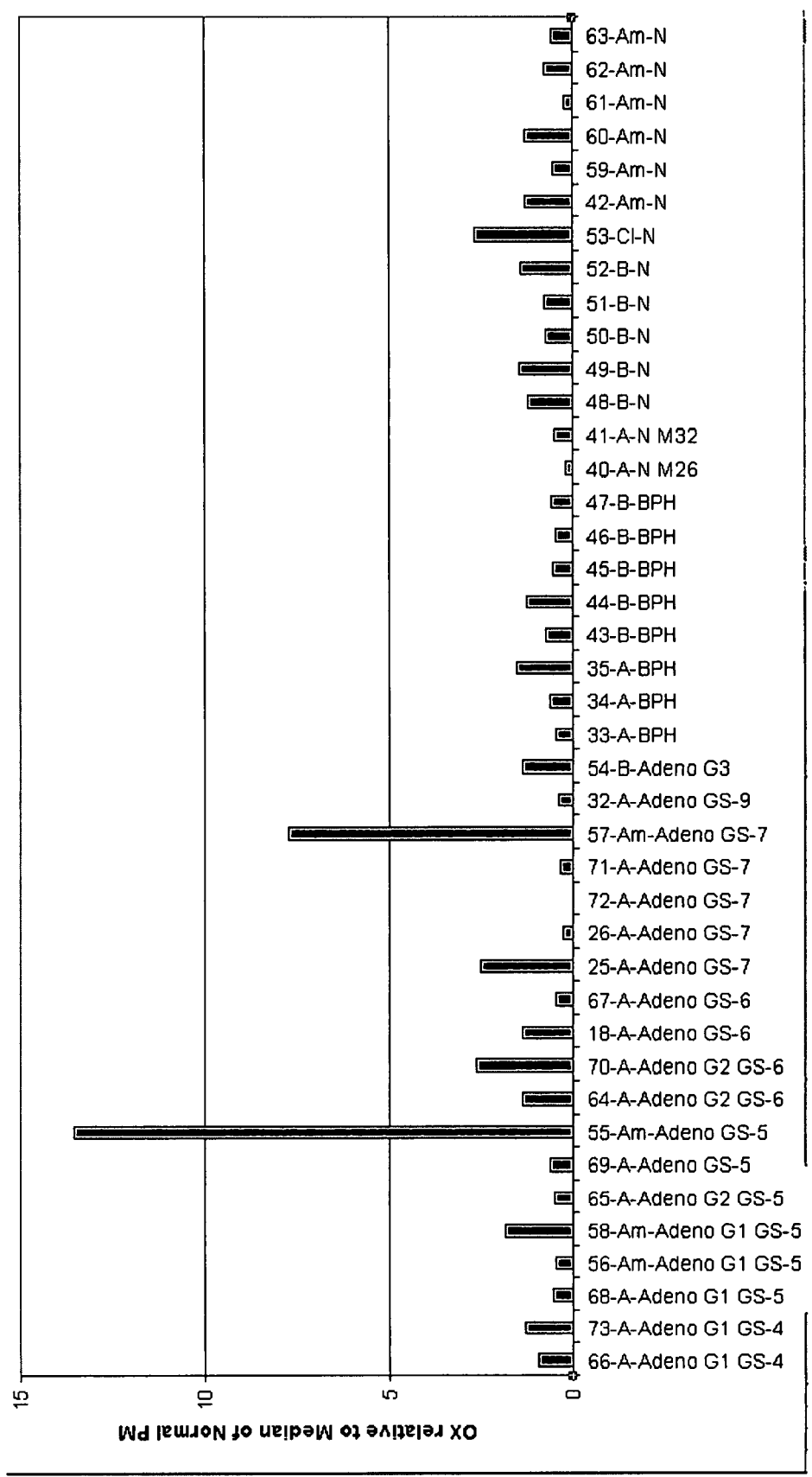
FIG. 10A are histograms showing over expression of the R11723 transcripts, which are detectable by amplicon as depicted in sequence name R11723 junc11-18 (SEQ ID NO:495) in cancerous prostate samples relative to the normal samples (FIG. 10A) or expression in normal tissues (FIG. 10B).

FIG. 10A is a histogram showing over expression of the above-indicated transcripts in cancerous prostate samples relative to the normal samples.

As is evident from FIG. 10A, the expression of transcripts detectable by the above amplicon in a few cancer samples was higher than in the non-cancerous samples (Sample Nos. 42, 48-53, 59-63, Table 1, above: "Tissue samples in prostate cancer testing panel"). Notably an over-expression of at least 5 fold was found in 2 out of 19 adenocarcinoma samples Primer pairs are also optionally and preferably encompassed within the present invention; for example, for the above experiment, the following primer pair was used as a non-limiting illustrative example only of a suitable primer pair: R11732junc11-18F forward primer (SEQ ID NO:493); and R11732 junc11-18R reverse primer (SEQ ID NO:494).

The present invention also preferably encompasses any amplicon obtained through the use of any suitable primer pair; for example, for the above experiment, the following amplicon was obtained as a non-limiting illustrative example only of a suitable amplicon: R11732 junc11-18 (SEQ ID NO:495)

```
R11723junc11-18F (SEQ ID NO: 493) -
AGTGATGGAGCAAAGTGCCG

R11723junc11-18R (SEQ ID NO: 494)-
CAGCAGCTGATGCAAACTGAG

R11723junc11-18 (SEQ ID NO: 495)-
AGTGATGGAGCAAAGTGCCGGGATCATGTACCGCAAGTCCTGTGCATCAT

CAGCGGCCTGTCTCATCGCCTCTGCCGGGTACCAGTCCTTCTGCTCCCCA

GGGAAACTGAACTCAGTTTGCATCAGCTGCTG
```

Expression of R11723 Transcripts, Which Were Detected by Amplicon_As Depicted in the Sequence Name R11723 junc11-18 (SEQ ID NO:495) in Different Normal Tissues.

Figure 10B:
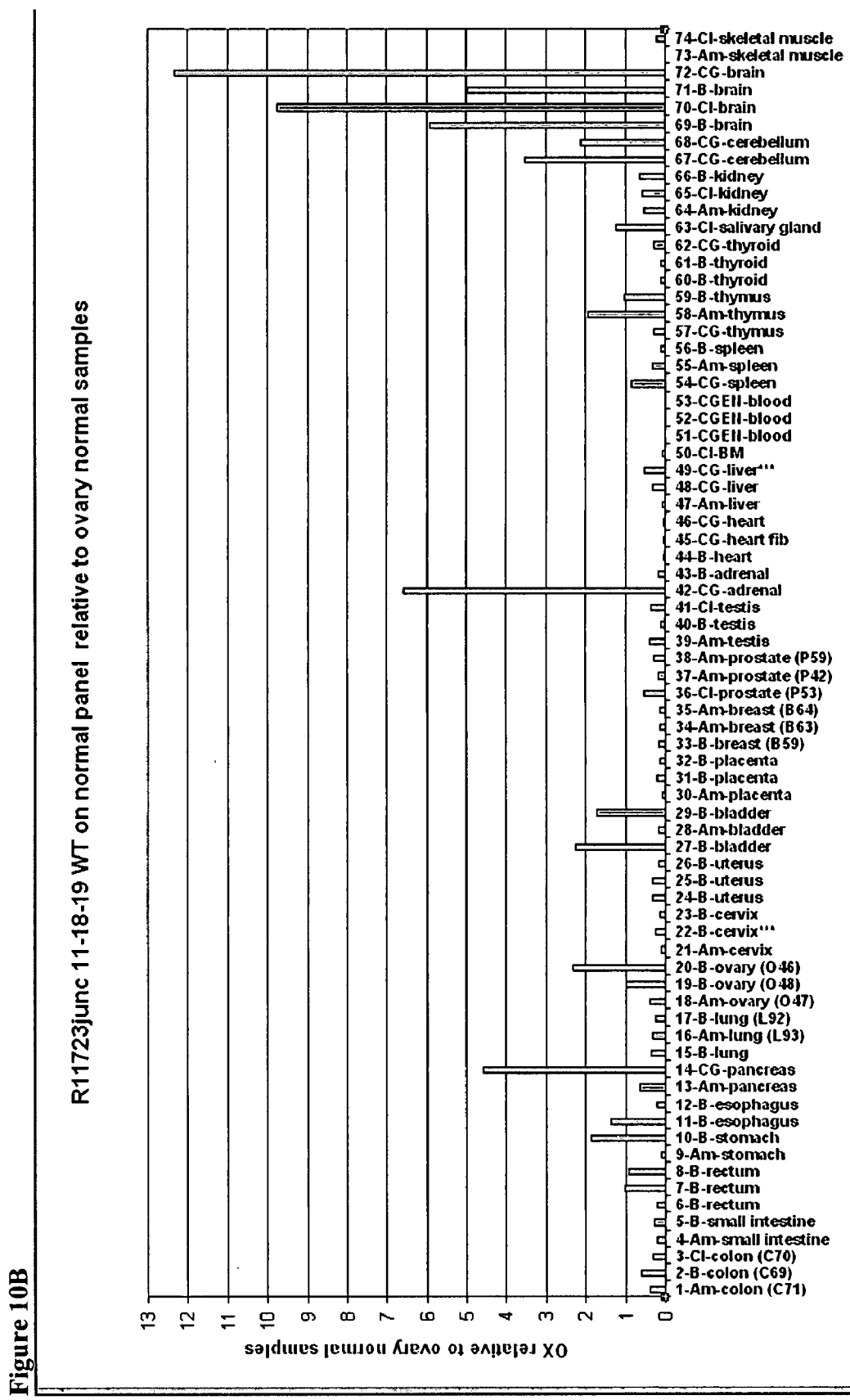

Expression of R11723 transcripts detectable by or according to R11723seg13 amplicon (SEQ ID NO:495) and R11723junc11-18F (SEQ ID NO:493), R11723junc11-18R (SEQ ID NO:494) was measured by real time PCR. In parallel the expression of four housekeeping genes RPL19 (GenBank Accession No. NM_000981 (SEQ ID NO:511); RPL19 amplicon (SEQ ID NO:410), TATA box (GenBank Accession No. NM_003194 (SEQ ID NO:512); TATA amplicon (SEQ ID NO:515), UBC (GenBank Accession No. BC000449 (SEQ ID NO:516); amplicon—Ubiquitin-amplicon (SEQ ID NO:519) and SDHA (GenBank Accession No. NM_004168 (SEQ ID NO:508); amplicon_—SDHA-amplicon (SEQ ID NO:407) was measured similarly. For each RT sample, the expression of the above amplicon_was normalized to the geometric mean of the quantities of the housekeeping genes. The normalized quantity of each RT sample was then divided by the median of the quantities of the ovary samples (Sample Nos. 18-20, Table 2, "Tissue samples in normal panel", above), to obtain a value of relative expression of each sample relative to median of the ovary samples. Results are shown in FIG. 10B; primers and amplicon are as above.

The expression of variant transcripts relating to the R11723 cluster (also known as PSEC) was found to be similar to that of the WT (known or wild type) protein; however in some cancers, expression of one or more variant transcripts was found to be higher (R11723_T5 for example in certain tissues).

Description for Cluster S78694

Cluster S78694 features 1 transcript(s) and 14 segment(s) of interest, the names for which are given in Tables 89 and 90, respectively, the sequences themselves are given at the end of the application. The selected protein variants are given in table 91.

TABLE 89

Transcripts of interest

| Transcript Name | Sequence ID No. |
| --- | --- |
| S78694_T7 | 11 |

TABLE 90

Segments of interest

| Segment Name | Sequence ID No. |
| --- | --- |
| S78694_node_0 | 116 |
| S78694_node_10 | 117 |
| S78694_node_12 | 118 |
| S78694_node_19 | 119 |
| S78694_node_21 | 120 |
| S78694_node_4 | 121 |
| S78694_node_1 | 122 |
| S78694_node_14 | 123 |
| S78694_node_16 | 124 |
| S78694_node_17 | 125 |
| S78694_node_2 | 126 |
| S78694_node_20 | 127 |
| S78694_node_3 | 128 |
| S78694_node_7 | 129 |

TABLE 91

Proteins of interest

| Protein Name | Sequence ID No. |
| --- | --- |
| S78694_P3 | 336 |

These sequences are variants of the known protein Protein-lysine 6-oxidase precursor (SEQ ID NO:385) (SwissProt accession identifier LYOX_HUMAN (SEQ ID NO 385):; known also according to the synonyms EC 1.4.3.13; Lysyl oxidase), SEQ ID NO: 385, referred to herein as the previously known protein.

Protein Protein-lysine 6-oxidase precursor (SEQ ID NO:385) is known or believed to have the following function(s): Responsible for the posttranslational oxidative deamination of peptidyl lysine residues in precursors to fibrous collagen and elastin. In addition to cross-linking of extracellular matrix proteins, may have a direct role in tumor suppression. The sequence for protein Protein-lysine 6-oxidase precursor (SEQ ID NO:385) is given at the end of the application, as "Protein-lysine 6-oxidase precursor (SEQ ID NO:385) amino acid sequence". Known polymorphisms for this sequence are as shown in Table 92.

TABLE 92

Amino acid mutations for Known Protein

| SNP position(s) on amino acid sequence | Comment |
| --- | --- |
| 158 | R -> Q (in dbSNP: 1800449). /FTId = VAR_004282. |
| 102 | A -> G |
| 137 | A -> R |
| 139 | A -> P |
| 304-305 | YD -> LY |
| 315 | V -> W |

Protein Protein-lysine 6-oxidase precursor (SEQ ID NO:385) localization is believed to be Extracellular.

The following GO Annotation(s) apply to the previously known protein. The following annotation(s) were found: protein modification, which are annotation(s) related to Biological Process; protein-lysine 6-oxidase; copper binding; oxidoreductase, which are annotation(s) related to Molecular Function; and extracellular matrix, which are annotation(s) related to Cellular Component.

The GO assignment relies on information from one or more of the SwissProt/TremB1 Protein knowledgebase, available from expasydot ch/sprot/; or Locuslink, available from ncbidot nlmdot nihdot gov/projects/LocusLink/.

As noted above, cluster S78694 features 1 transcript(s), which were listed in Table 89 above. These transcript(s) encode for protein(s) which are variant(s) of protein Protein-lysine 6-oxidase precursor (SEQ ID NO:385). A description of each variant protein according to the present invention is now provided.

Variant protein S78694_P3 (SEQ ID NO:336) according to the present invention has an amino acid sequence as given at the end of the application; it is encoded by transcript(s) S78694_T7 (SEQ ID NO:11). An alignment is given to the known protein (Protein-lysine 6-oxidase precursor (SEQ ID NO:385) at the end of the application. One or more alignments to one or more previously published protein sequences are given at the end of the application. A brief description of the relationship of the variant protein according to the present invention to each such aligned protein is as follows:

Comparison report between S78694_P3 (SEQ ID NO:336) and LYOX_HUMAN:

1. An isolated chimeric polypeptide encoding for S78694_P3 (SEQ ID NO:336) comprising a first amino acid sequence being at least 90% homologous to MRFAWTV-LLLGPLQLCALVHCAPPAAGQQQPPREP-PAAPGAWRQQIQWENNGQVFSL LSLGSQYQPQR-RRDPGAAVPGAANASAQQPRTPILLIRDNRTAAART RTAGSSGVTAGR PRPTARHWFQAGYSTSRAREA-GASRAENQTAPGEVPALSNLRPPSRVDG-MVGDDPYNP YKYSDDNPYYNYYDTYERPRPG-GRYRPGYGTGYFQYGLPDLVADPYYIQASTYVQKM SMYNLRCAAEENCLAS corresponding to amino acids 1-247 of LYOX_HUMAN, which also corresponds to amino acids 1-247 of S78694_P3 (SEQ ID NO:336), and a second amino acid sequence being at least 70%, optionally at least 80%, preferably at least 85%, more preferably at least 90% and most preferably at least 95% homologous to a polypeptide having the sequence IQGRCQRL (SEQ ID NO: 541) corresponding to amino acids 248-255 of S78694_P3 (SEQ ID NO:336), wherein said first and second amino acid sequences are contiguous and in a sequential order.

2. An isolated polypeptide encoding for a tail of S78694_P3 (SEQ ID NO:336) comprising a polypeptide being at least 70%, optionally at least about 80%, preferably at least about 85%, more preferably at least about 90% and most preferably at least about 95% homologous to the sequence IQGRCQRL (SEQ ID NO: 541) in S78694_P3 (SEQ ID NO:336).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein S78694_P3 (SEQ ID NO:336) also has the following non-silent SNPs (Single Nucleotide Polymorphisms) as listed in Table 93, (given according to their position(s) on the amino acid sequence, with the alternative amino acid(s) listed; the last column indicates whether the SNP is known or not; the presence of known SNPs in variant protein S78694_P3 (SEQ ID NO:336) sequence provides support for the deduced sequence of this variant protein according to the present invention).

TABLE 93

Amino acid mutations

| SNP position(s) on amino acid sequence | Alternative amino acid(s) | Previously known SNP? |
| --- | --- | --- |
| 137 | A -> P | Yes |
| 145 | Q -> R | No |
| 158 | R -> Q | Yes |
| 7 | V -> A | No |

Variant protein S78694_P3 (SEQ ID NO:336) is encoded by the following transcript(s): S78694_T7 (SEQ ID NO:11), for which the sequence(s) is/are given at the end of the application. The coding portion of transcript S78694_T7 (SEQ ID NO:11) is shown in bold; this coding portion starts at position 381 and ends at position 1145. The transcript also has the following SNPs as listed in Table 94 (given according to their position on the nucleotide sequence, with the alternative nucleic acid listed; the last column indicates whether the SNP is known or not; the presence of known SNPs in variant protein S78694_P3 (SEQ ID NO:336) sequence provides support for the deduced sequence of this variant protein according to the present invention).

TABLE 94

Nucleic acid SNPs

| SNP position on nucleotide sequence | Alternative nucleic acid | Previously known SNP? |
| --- | --- | --- |
| 83 | A -> | No |
| 138 | C -> G | Yes |
| 3221 | T -> A | Yes |
| 3222 | T -> G | Yes |
| 3401 | C -> G | Yes |
| 3406 | T -> C | Yes |
| 191 | C -> | No |
| 400 | T -> C | No |
| 605 | C -> G | Yes |
| 789 | G -> C | Yes |
| 814 | A -> G | No |

TABLE 94-continued

Nucleic acid SNPs

| SNP position on nucleotide sequence | Alternative nucleic acid | Previously known SNP? |
| --- | --- | --- |
| 853 | G -> A | Yes |
| 1193 | G -> A | Yes |
| 1194 | G -> A | Yes |

As noted above, cluster S78694 features 14 segment(s), which were listed in Table 90 above and for which the sequence(s) are given at the end of the application. These segment(s) are portions of nucleic acid sequence(s) which are described herein separately because they are of particular interest. A description of each segment according to the present invention is now provided.

Segment cluster S78694_node_0 (SEQ ID NO:116) according to the present invention is supported by 49 libraries. The number of libraries was determined as previously described. This segment can be found in the following transcript(s): S78694_T7 (SEQ ID NO:11). Table 94 below describes the starting and ending position of this segment on each transcript.

TABLE 94

Segment location on transcripts

| Transcript name | Segment starting position | Segment ending position |
| --- | --- | --- |
| S78694_T7 (SEQ ID NO:11) | 1 | 609 |

Segment cluster S78694_node_10 (SEQ ID NO:117) according to the present invention is supported by 54 libraries. The number of libraries was determined as previously described. This segment can be found in the following transcript(s): S78694_T7 (SEQ ID NO:11). Table 95 below describes the starting and ending position of this segment on each transcript.

TABLE 95

Segment location on transcripts

| Transcript name | Segment starting position | Segment ending position |
| --- | --- | --- |
| S78694_T7 (SEQ ID NO:11) | 1121 | 1253 |

Segment cluster S78694_node_12 (SEQ ID NO:118) according to the present invention is supported by 57 libraries. The number of libraries was determined as previously described. This segment can be found in the following transcript(s): S78694_T7 (SEQ ID NO:11). Table 96 below describes the starting and ending position of this segment on each transcript.

TABLE 96

Segment location on transcripts

| Transcript name | Segment starting position | Segment ending position |
| --- | --- | --- |
| S78694_T7 (SEQ ID NO:11) | 1254 | 1410 |

Segment cluster S78694_node_19 (SEQ ID NO:119) according to the present invention is supported by 151 libraries. The number of libraries was determined as previously described. This segment can be found in the following transcript(s): S78694_T7 (SEQ ID NO:11). Table 97 below describes the starting and ending position of this segment on each transcript.

TABLE 97

Segment location on transcripts

| Transcript name | Segment starting position | Segment ending position |
|---|---|---|
| S78694_T7 (SEQ ID NO:11) | 1623 | 3620 |

Segment cluster S78694_node_21 (SEQ ID NO:120) according to the present invention is supported by 89 libraries. The number of libraries was determined as previously described. This segment can be found in the following transcript(s): S78694_T7 (SEQ ID NO:11). Table 98 below describes the starting and ending position of this segment on each transcript.

TABLE 98

Segment location on transcripts

| Transcript name | Segment starting position | Segment ending position |
|---|---|---|
| S78694_T7 (SEQ ID NO:11) | 3629 | 3866 |

Segment cluster S78694_node_4 (SEQ ID NO:121) according to the present invention is supported by 48 libraries. The number of libraries was determined as previously described. This segment can be found in the following transcript(s): S78694_T7 (SEQ ID NO:11). Table 99 below describes the starting and ending position of this segment on each transcript.

TABLE 99

Segment location on transcripts

| Transcript name | Segment starting position | Segment ending position |
|---|---|---|
| S78694_T7 (SEQ ID NO:11) | 740 | 1011 |

According to an optional embodiment of the present invention, short segments related to the above cluster are also provided. These segments are up to about 120 bp in length, and so are included in a separate description.

Segment cluster S78694_node_1 (SEQ ID NO:122) according to the present invention is supported by 39 libraries. The number of libraries was determined as previously described. This segment can be found in the following transcript(s): S78694_T7 (SEQ ID NO:11). Table 100 below describes the starting and ending position of this segment on each transcript.

TABLE 100

Segment location on transcripts

| Transcript name | Segment starting position | Segment ending position |
|---|---|---|
| S78694_T7 (SEQ ID NO:11) | 610 | 668 |

Segment cluster S78694_node_14 (SEQ ID NO:123) according to the present invention is supported by 51 libraries. The number of libraries was determined as previously described. This segment can be found in the following transcript(s): S78694_T7 (SEQ ID NO:11). Table 101 below describes the starting and ending position of this segment on each transcript.

TABLE 101

Segment location on transcripts

| Transcript name | Segment starting position | Segment ending position |
|---|---|---|
| S78694_T7 (SEQ ID NO:11) | 1411 | 1506 |

Segment cluster S78694_node_16 (SEQ ID NO:124) according to the present invention can be found in the following transcript(s): S78694_T7 (SEQ ID NO:11). Table 102 below describes the starting and ending position of this segment on each transcript.

TABLE 102

Segment location on transcripts

| Transcript name | Segment starting position | Segment ending position |
|---|---|---|
| S78694_T7 (SEQ ID NO:11) | 1507 | 1530 |

Segment cluster S78694_node_17 (SEQ ID NO:125) according to the present invention is supported by 45 libraries. The number of libraries was determined as previously described. This segment can be found in the following transcript(s): S78694_T7 (SEQ ID NO:11). Table 103 below describes the starting and ending position of this segment on each transcript.

TABLE 103

Segment location on transcripts

| Transcript name | Segment starting position | Segment ending position |
|---|---|---|
| S78694_T7 (SEQ ID NO:11) | 1531 | 1622 |

Segment cluster S78694_node_2 (SEQ ID NO:126) according to the present invention can be found in the following transcript(s): S78694_T7 (SEQ ID NO:11). Table 104 below describes the starting and ending position of this segment on each transcript.

TABLE 104

Segment location on transcripts

| Transcript name | Segment starting position | Segment ending position |
|---|---|---|
| S78694_T7 (SEQ ID NO:11) | 669 | 676 |

Segment cluster S78694_node_20 (SEQ ID NO:127) according to the present invention can be found in the following transcript(s): S78694_T7 (SEQ ID NO:1). Table 105 below describes the starting and ending position of this segment on each transcript.

TABLE 105

Segment location on transcripts

| Transcript name | Segment starting position | Segment ending position |
|---|---|---|
| S78694_T7 (SEQ ID NO:11) | 3621 | 3628 |

Segment cluster S78694_node_3 (SEQ ID NO:128) according to the present invention is supported by 38 libraries. The number of libraries was determined as previously described. This segment can be found in the following transcript(s): S78694_T7 (SEQ ID NO:11). Table 106 below describes the starting and ending position of this segment on each transcript.

TABLE 106

Segment location on transcripts

| Transcript name | Segment starting position | Segment ending position |
|---|---|---|
| S78694_T7 (SEQ ID NO:11) | 677 | 739 |

Segment cluster S78694_node_7 (SEQ ID NO:129) according to the present invention is supported by 37 libraries. The number of libraries was determined as previously described. This segment can be found in the following transcript(s): S78694_T7 (SEQ ID NO:11). Table 107 below describes the starting and ending position of this segment on each transcript.

TABLE 107

Segment location on transcripts

| Transcript name | Segment starting position | Segment ending position |
|---|---|---|
| S78694_T7 (SEQ ID NO:11) | 1012 | 1120 |

Variant Protein Alignment to the Previously Known Protein:

```
Sequence name: /tmp/Z5Xt1z65PJ/KPuD7VdmQ2:LYOX_HUMAN
Sequence documentation:
Alignment of: S78694_P3 (SEQ ID NO:336) x LYOX_HUMAN . . .
Alignment segment 1/1:
Quality:                        2477.00
Escore:                               0
Matching length:                    247
Total length:                       247
Matching Percent Similarity:     100.00
Matching Percent Identity:       100.00
Total Percent Similarity:        100.00
Total Percent Identity:          100.00
Gaps:                                 0

Alignment:
    1  MRFAWTVLLLGPLQLCALVHCAPPAAGQQQPPREPPAAPGAWRQQIQWEN    50
       ||||||||||||||||||||||||||||||||||||||||||||||||||
    1  MRFAWTVLLLGPLQLCALVHCAPPAAGQQQPPREPPAAPGAWRQQIQWEN    50

51  NGQVFSLLSLGSQYQPQRRRDPGAAVPGAANASAQQPRTPILLIRDNRTA   100
       ||||||||||||||||||||||||||||||||||||||||||||||||||
   51  NGQVFSLLSLGSQYQPQRRRDPGAAVPGAANASAQQPRTPILLIRDNRTA   100

101  AARTRTAGSSGVTAGRPRPTARHWFQAGYSTSRAREAGASRAENQTAPGE   150
       ||||||||||||||||||||||||||||||||||||||||||||||||||
  101  AARTRTAGSSGVTAGRPRPTARHWFQAGYSTSRAREAGASRAENQTAPGE   150

151  VPALSNLRPPSRVDGMVGDDPYNPYKYSDDNPYYNYYDTYERPRPGGRYR   200
       ||||||||||||||||||||||||||||||||||||||||||||||||||
  151  VPALSNLRPPSRVDGMVGDDPYNPYKYSDDNPYYNYYDTYERPRPGGRYR   200

201  PGYGTGYFQYGLPDLVADPYYIQASTYVQKMSMYNLRCAAEENCLAS      247
       ||||||||||||||||||||||||||||||||||||||||||||||
  201  PGYGTGYFQYGLPDLVADPYYIQASTYVQKMSMYNLRCAAEENCLAS      247
```

Description for Cluster W60282

Cluster W60282 features 1 transcript(s) and 6 segment(s) of interest, the names for which are given in Tables 108 and 109, respectively, the sequences themselves are given at the end of the application. The selected protein variants are given in table 110.

TABLE 108

Transcripts of interest

| Transcript Name | Sequence ID No. |
|---|---|
| W60282_PEA_1_T11 | 12 |

TABLE 109

Segments of interest

| Segment Name | Sequence ID No. |
|---|---|
| W60282_PEA_1_node_10 | 130 |
| W60282_PEA_1_node_18 | 131 |
| W60282_PEA_1_node_22 | 132 |
| W60282_PEA_1_node_5 | 133 |
| W60282_PEA_1_node_21 | 134 |
| W60282_PEA_1_node_8 | 135 |

TABLE 110

Proteins of interest

| Protein Name | Sequence ID No. |
|---|---|
| W60282_PEA_1_P14 | 337 |

These sequences are variants of the known protein Kallikrein 11 precursor (SEQ ID NO:386) (SwissProt accession identifier KLKB_HUMAN (SEQ ID NO: 386); known also according to the synonyms EC 3.4.21.-; Hippostasin; Trypsin-like protease), SEQ ID NO: 386, referred to herein as the previously known protein.

Protein Kallikrein 11 precursor (SEQ ID NO:386) is known or believed to have the following function(s): Possible multifunctional protease. Efficiently cleaves bz-Phe-Arg-4-methylcoumaryl-7-amide, a kallikrein substrate, and weakly cleaves other substrates for kallikrein and trypsin. The sequence for protein Kallikrein 11 precursor (SEQ ID NO:386) is given at the end of the application, as "Kallikrein 11 precursor (SEQ ID NO:386) amino acid sequence". Protein Kallikrein 11 precursor (SEQ ID NO:386) localization is believed to be Secreted.

The following GO Annotation(s) apply to the previously known protein. The following annotation(s) were found: proteolysis and peptidolysis, which are annotation(s) related to Biological Process; and chymotrypsin; trypsin; serine-type peptidase; hydrolase, which are annotation(s) related to Molecular Function.

The GO assignment relies on information from one or more of the SwissProt/TremB1 Protein knowledgebase, available from expasydot ch/sprot/; or Locuslink, available from ncbidot nlmdot nihdot gov/projects/LocusLink/.

As noted above, cluster W60282 features 1 transcript(s), which were listed in Table 108 above. These transcript(s) encode for protein(s) which are variant(s) of protein Kallikrein 11 precursor (SEQ ID NO:386). A description of each variant protein according to the present invention is now provided.

Variant protein W60282_PEA_1_P14 (SEQ ID NO:337) according to the present invention has an amino acid sequence as given at the end of the application; it is encoded by transcript(s) W60282_PEA_1_T11 (SEQ ID NO:12). An alignment is given to the known protein (Kallikrein 11 precursor (SEQ ID NO:386) at the end of the application. One or more alignments to one or more previously published protein sequences are given at the end of the application. A brief description of the relationship of the variant protein according to the present invention to each such aligned protein is as follows:

Comparison report between W60282_PEA_1_P14 (SEQ ID NO:337) and Q8IXD7 (SEQ ID NO:496):

1. An isolated chimeric polypeptide encoding for W60282_PEA_1_P14 (SEQ ID NO:337), comprising a first amino acid sequence being at least 90% homologous to MRILQLILLALATGLVGGETRIIKG-FECKPHSQPWQAALFEKTRLLCGATLIAPRWLLTA AHCLKP corresponding to amino acids 1-66 of Q8IXD7, which also corresponds to amino acids 1-66 of W60282_PEA_1_P14 (SEQ ID NO:337), and a second amino acid sequence being at least 70%, optionally at least 80%, preferably at least 85%, more preferably at least 90% and most preferably at least 95% homologous to a polypeptide having the sequence TPASHLAMRQHHHH (SEQ ID NO: 542) corresponding to amino acids 67-80 of W60282_PEA_1_P14 (SEQ ID NO:337), wherein said first and second amino acid sequences are contiguous and in a sequential order.

2. An isolated polypeptide encoding for a tail of W60282_PEA_1_P14 (SEQ ID NO:337), comprising a polypeptide being at least 70%, optionally at least about 80%, preferably at least about 85%, more preferably at least about 90% and most preferably at least about 95% homologous to the sequence TPASHLAMRQHHHH (SEQ ID NO: 542) in W60282_PEA_1_P14 (SEQ ID NO:337).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein W60282_PEA_1_P14 (SEQ ID NO:337) also has the following non-silent SNPs (Single Nucleotide Polymorphisms) as listed in Table 111, (given according to their position(s) on the amino acid sequence, with the alternative amino acid(s) listed; the last column indicates whether the SNP is known or not; the presence of known SNPs in variant protein W60282_PEA_1_P14 (SEQ ID NO:337) sequence provides support for the deduced sequence of this variant protein according to the present invention).

TABLE 111

Amino acid mutations

| SNP position(s) on amino acid sequence | Alternative amino acid(s) | Previously known SNP? |
|---|---|---|
| 17 | G -> E | Yes |
| 41 | E -> K | No |

Variant protein W60282_PEA_1_P14 (SEQ ID NO:337) is encoded by the following transcript(s): W60282_PEA_1_T11 (SEQ ID NO:12), for which the sequence(s) is/are given at the end of the application. The coding portion of transcript W60282_PEA_1_T 11 (SEQ ID NO:12) is shown in bold; this coding portion starts at position 705 and ends at position 944. The transcript also has the following SNPs as listed in Table 112 (given according to their position on the nucleotide sequence, with the alternative nucleic acid listed; the last column indicates whether the SNP is known or not; the presence of known SNPs in variant protein W60282_PEA_1_P14 (SEQ ID NO:337) sequence provides support for the deduced sequence of this variant protein according to the present invention).

TABLE 112

Nucleic acid SNPs

| SNP position on nucleotide sequence | Alternative nucleic acid | Previously known SNP? |
| --- | --- | --- |
| 219 | A -> G | Yes |
| 702 | G -> A | Yes |
| 754 | G -> A | Yes |
| 825 | G -> A | No |
| 1289 | A -> G | Yes |

As noted above, cluster W60282 features 6 segment(s), which were listed in Table 109 above and for which the sequence(s) are given at the end of the application. These segment(s) are portions of nucleic acid sequence(s) which are described herein separately because they are of particular interest. A description of each segment according to the present invention is now provided.

Segment cluster W60282_PEA_1_node_10 (SEQ ID NO:130) according to the present invention is supported by 45 libraries. The number of libraries was determined as previously described. This segment can be found in the following transcript(s): W60282_PEA_1_T11 (SEQ ID NO:12). Table 113 below describes the starting and ending position of this segment on each transcript.

TABLE 113

Segment location on transcripts

| Transcript name | Segment starting position | Segment ending position |
| --- | --- | --- |
| W60282_PEA_1_T11 (SEQ ID NO:12) | 745 | 901 |

Segment cluster W60282_PEA_1_node_18 (SEQ ID NO:131) according to the present invention is supported by 49 libraries. The number of libraries was determined as previously described. This segment can be found in the following transcript(s): W60282_PEA_1_T 11 (SEQ ID NO:12). Table 114 below describes the starting and ending position of this segment on each transcript.

TABLE 114

Segment location on transcripts

| Transcript name | Segment starting position | Segment ending position |
| --- | --- | --- |
| W60282_PEA_1_T11 (SEQ ID NO:12) | 902 | 1038 |

Segment cluster W60282_PEA_1_node_22 (SEQ ID NO:132) according to the present invention is supported by 67 libraries. The number of libraries was determined as previously described. This segment can be found in the following transcript(s): W60282_PEA_1_T 1 (SEQ ID NO:12). Table 115 below describes the starting and ending position of this segment on each transcript.

TABLE 115

Segment location on transcripts

| Transcript name | Segment starting position | Segment ending position |
| --- | --- | --- |
| W60282_PEA_1_T11 (SEQ ID NO:12) | 1072 | 1507 |

Segment cluster W60282_PEA_1_node_5 (SEQ ID NO:133) according to the present invention is supported by 20 libraries. The number of libraries was determined as previously described. This segment can be found in the following transcript(s): W60282_PEA_1_T 1 (SEQ ID NO:12). Table 116 below describes the starting and ending position of this segment on each transcript.

TABLE 116

Segment location on transcripts

| Transcript name | Segment starting position | Segment ending position |
| --- | --- | --- |
| W60282_PEA_1_T11 (SEQ ID NO:12) | 1 | 669 |

According to an optional embodiment of the present invention, short segments related to the above cluster are also provided. These segments are up to about 120 bp in length, and so are included in a separate description.

Segment cluster W60282_PEA_1_node_21 (SEQ ID NO:134) according to the present invention is supported by 48 libraries. The number of libraries was determined as previously described. This segment can be found in the following transcript(s): W60282_PEA_1_T 1 (SEQ ID NO:12). Table 117 below describes the starting and ending position of this segment on each transcript.

TABLE 117

Segment location on transcripts

| Transcript name | Segment starting position | Segment ending position |
| --- | --- | --- |
| W60282_PEA_1_T11 (SEQ ID NO:12) | 1039 | 1071 |

Segment cluster W60282_PEA_1_node_8 (SEQ ID NO:135) according to the present invention is supported by 39 libraries. The number of libraries was determined as previously described. This segment can be found in the following transcript(s): W60282_PEA_1_T 11 (SEQ ID NO:12). Table 118 below describes the starting and ending position of this segment on each transcript.

TABLE 118

Segment location on transcripts

| Transcript name | Segment starting position | Segment ending position |
| --- | --- | --- |
| W60282_PEA_1_T11 (SEQ ID NO:12) | 670 | 744 |

Variant Protein Alignment to the Previously Known Protein:

```
Sequence name: /tmp/rL7Wdc5hYg/eLOAfKIgqD:KLKB_HUMAN
Sequence documentation:
Alignment of: W60282_PEA_1_P14 (SEQ ID NO:337) x KLKB_HUMAN . . .
Alignment segment 1/1:
Quality:                           645.00
Escore:                                 0
Matching length:                       72
Total length:                          72
Matching Percent Similarity:        94.44
Matching Percent Identity:          94.44
Total Percent Similarity:           94.44
Total Percent Identity:             94.44
Gaps:                                   0

Alignment:

1   MRILQLILLALATGLVGGETRIIKGFECKPHSQPWQAALFEKTRLLCGAT   50
      ||||||||||||||||||||||||||||||||||||||||||||||||||
  1   MRILQLILLALATGLVGGETRIIKGFECKPHSQPWQAALFEKTRLLCGAT   50

51   LIAPRWLLTAAHCLKPTPASHL                               72
      ||||||||||||||||||| |
 51   LIAPRWLLTAAHCLKPRYIVHL                               72

Sequence name: /tmp/rL7Wdc5hYg/eLOAfKIgqD:Q8IXD7
Sequence documentation:
Alignment of: W60282_PEA_1_P14 (SEQ ID NO:337) x Q8IXD7 . . .
Alignment segment 1/1:
Quality:                           642.00
Escore:                                 0
Matching length:                       66
Total length:                          66
Matching Percent Similarity:       100.00
Matching Percent Identity:         100.00
Total Percent Similarity:          100.00
Total Percent Identity:            100.00
Gaps:                                   0

Alignment:

1   MRILQLILLALATGLVGGETRIIKGFECKPHSQPWQAALFEKTRLLCGAT   50
      ||||||||||||||||||||||||||||||||||||||||||||||||||
  1   MRILQLILLALATGLVGGETRIIKGFECKPHSQPWQAALFEKTRLLCGAT   50

51   LIAPRWLLTAAHCLKP                                     66
      ||||||||||||||||
 51   LIAPRWLLTAAHCLKP                                     66
```

Description for Cluster HUMTREFAC

Cluster HUMTREFAC features 2 transcript(s) and 7 segment(s) of interest, the names for which are given in Tables 119 and 120, respectively, the sequences themselves are given at the end of the application. The selected protein variants are given in table 121.

TABLE 119

Transcripts of interest

| Transcript Name | Sequence ID No. |
|---|---|
| HUMTREFAC_PEA_2_T4 | 13 |
| HUMTREFAC_PEA_2_T5 | 14 |

TABLE 120

Segments of interest

| Segment Name | Sequence ID No. |
|---|---|
| HUMTREFAC_PEA_2_node_0 | 136 |
| HUMTREFAC_PEA_2_node_9 | 137 |
| HUMTREFAC_PEA_2_node_2 | 138 |
| HUMTREFAC_PEA_2_node_3 | 139 |
| HUMTREFAC_PEA_2_node_4 | 140 |
| HUMTREFAC_PEA_2_node_5 | 141 |
| HUMTREFAC_PEA_2_node_8 | 142 |

TABLE 121

Proteins of interest

| Protein Name | Sequence ID No. | Corresponding Transcript(s) |
|---|---|---|
| HUMTREFAC_PEA_2_P7 | 338 | HUMTREFAC_PEA_2_T5 (SEQ ID NO:14) |
| HUMTREFAC_PEA_2_P8 | 339 | HUMTREFAC_PEA_2_T4 (SEQ ID NO:13) |

These sequences are variants of the known protein Trefoil factor 3 precursor (SEQ ID NO:387) (SwissProt accession identifier TFF3_HUMAN (SEQ ID NO 387); known also according to the synonyms Intestinal trefoil factor; hP1.B), SEQ ID NO: 387, referred to herein as the previously known protein.

Protein Trefoil factor 3 precursor (SEQ ID NO:387) is known or believed to have the following function(s): May have a role in promoting cell migration (motogen). The sequence for protein Trefoil factor 3 precursor (SEQ ID NO:387) is given at the end of the application, as "Trefoil factor 3 precursor (SEQ ID NO:387) amino acid sequence". Known polymorphisms for this sequence are as shown in Table 122.

TABLE 122

Amino acid mutations for Known Protein

| SNP position(s) on amino acid sequence | Comment |
|---|---|
| 74–76 | QEA -> TRKT |

Protein Trefoil factor 3 precursor (SEQ ID NO:387) localization is believed to be Secreted.

The following GO Annotation(s) apply to the previously known protein. The following annotation(s) were found: defense response; digestion, which are annotation(s) related to Biological Process; and extracellular, which are annotation(s) related to Cellular Component.

The GO assignment relies on information from one or more of the SwissProt/TremB1 Protein knowledgebase, available from expasydot ch/sprot/; or Locuslink, available from ncbidot nlmdot nihdot gov/projects/LocusLink/.

Cluster HUMTREFAC can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 11 refer to weighted expression of ESTs in each category, as "parts per million" (ratio of the expression of ESTs for a particular cluster to the expression of all ESTs in that category, according to parts per million).

Figure 11:
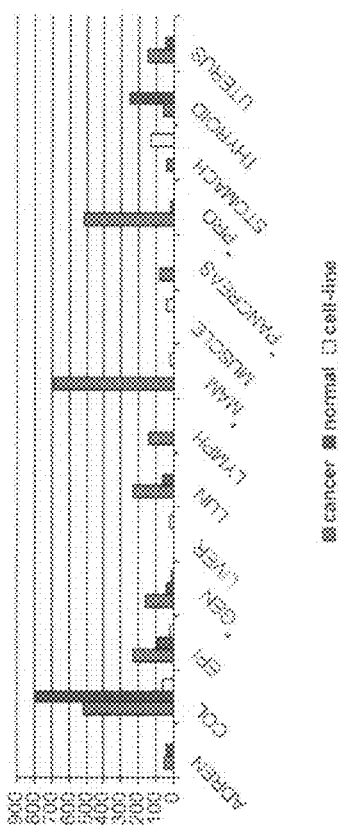
FIG. 11 is a histogram showing Cancer and cell-line vs. normal tissue expression for Cluster HUMTREFAC, demonstrating overexpression in a mixture of malignant tumors from different tissues, breast malignant tumors, pancreas carcinoma and prostate cancer.

Overall, the following results were obtained as shown with regard to the histograms in FIG. 11 and Table 123. This cluster is overexpressed (at least at a minimum level) in the following pathological conditions: a mixture of malignant tumors from different tissues, breast malignant tumors, pancreas carcinoma and prostate cancer.

TABLE 123

Normal tissue distribution

| Name of Tissue | Number |
|---|---|
| Adrenal | 40 |
| Colon | 797 |
| Epithelial | 95 |
| General | 39 |
| Liver | 0 |
| Lung | 57 |
| Lymph nodes | 3 |
| Breast | 0 |
| Muscle | 3 |
| Pancreas | 2 |
| Prostate | 16 |
| Stomach | 0 |
| Thyroid | 257 |
| Uterus | 54 |

TABLE 124

P values and ratios for expression in cancerous tissue

| Name of Tissue | P1 | P2 | SP1 | R3 | SP2 | R4 |
|---|---|---|---|---|---|---|
| Adrenal | 6.4e−01 | 6.9e−01 | 7.1e−01 | 1.1 | 7.8e−01 | 0.9 |
| Colon | 4.6e−01 | 5.7e−01 | 9.7e−01 | 0.5 | 1 | 0.4 |
| Epithelial | 2.4e−02 | 3.4e−01 | 9.5e−10 | 2.0 | 5.3e−02 | 1.1 |
| General | 2.5e−04 | 3.9e−02 | 1.4e−28 | 3.6 | 1.9e−10 | 1.9 |
| Liver | 1 | 6.8e−01 | 1 | 1.0 | 6.9e−01 | 1.4 |
| Lung | 4.8e−01 | 7.6e−01 | 2.2e−03 | 1.0 | 1.6e−01 | 0.5 |
| Lymph nodes | 5.1e−01 | 8.0e−01 | 2.3e−02 | 5.0 | 1.9e−01 | 2.1 |
| Breast | 7.6e−02 | 1.2e−01 | 3.1e−06 | 12.0 | 1.1e−03 | 6.5 |
| Muscle | 9.2e−01 | 4.8e−01 | 1 | 0.8 | 3.9e−01 | 2.1 |
| Pancreas | 1.2e−01 | 2.4e−01 | 5.7e−03 | 6.5 | 2.1e−02 | 4.6 |
| Prostate | 1.5e−01 | 2.7e−01 | 9.9e−10 | 8.1 | 3.1e−07 | 5.7 |
| Stomach | 3.0e−01 | 1.3e−01 | 5.0e−01 | 2.0 | 6.7e−02 | 2.8 |
| Thyroid | 6.4e−01 | 6.4e−01 | 9.6e−01 | 0.5 | 9.6e−01 | 0.5 |
| Uterus | 4.1e−01 | 7.3e−01 | 7.5e−02 | 1.3 | 4.0e−01 | 0.8 |

As noted above, cluster HUMTREFAC features 2 transcript(s), which were listed in Table 119 above. These transcript(s) encode for protein(s) which are variant(s) of protein Trefoil factor 3 precursor (SEQ ID NO:387). A description of each variant protein according to the present invention is now provided.

Variant protein HUMTREFAC_PEA_2_P7 (SEQ ID NO:338) according to the present invention has an amino acid sequence as given at the end of the application; it is encoded by transcript(s) HUMTREFAC_PEA_2_T5 (SEQ ID NO:14). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTREFAC_PEA_2_P7 (SEQ ID NO:338) also has the following non-silent SNPs (Single Nucleotide Polymorphisms) as listed in Table 125, (given according to their position(s) on the amino acid sequence, with the alternative amino acid(s) listed; the last column indicates whether the SNP is known or not; the presence of known SNPs in variant protein HUMTREFAC_PEA_2_P7

(SEQ ID NO:338) sequence provides support for the deduced sequence of this variant protein according to the present invention).

TABLE 125

Amino acid mutations

| SNP position(s) on amino acid sequence | Alternative amino acid(s) | Previously known SNP? |
|---|---|---|
| 5 | A -> S | No |
| 5 | A -> T | No |
| 14 | A -> V | Yes |
| 43 | L -> M | No |
| 60 | P -> S | Yes |
| 123 | S -> * | Yes |

Variant protein HUMTREFAC_PEA_2_P7 (SEQ ID NO:338) is encoded by the following transcript(s): HUMTREFAC_PEA_2_T5 (SEQ ID NO:14), for which the sequence(s) is/are given at the end of the application. The coding portion of transcript HUMTREFAC_PEA_2_T5 (SEQ ID NO:14) is shown in bold; this coding portion starts at position 278 and ends at position 688. The transcript also has the following SNPs as listed in Table 126 (given according to their position on the nucleotide sequence, with the alternative nucleic acid listed; the last column indicates whether the SNP is known or not; the presence of known SNPs in variant protein HUMTREFAC_PEA_2_P7 (SEQ ID NO:338) sequence provides support for the deduced sequence of this variant protein according to the present invention).

TABLE 126

Nucleic acid SNPs

| SNP position on nucleotide sequence | Alternative nucleic acid | Previously known SNP? |
|---|---|---|
| 233 | A -> G | Yes |
| 290 | G -> A | No |
| 290 | G -> T | No |
| 318 | C -> T | Yes |
| 404 | C -> A | No |
| 404 | C -> T | No |
| 455 | C -> T | Yes |
| 645 | C -> A | Yes |
| 685 | C -> T | No |

Variant protein HUMTREFAC_PEA_2_P8 (SEQ ID NO:339) according to the present invention has an amino acid sequence as given at the end of the application; it is encoded by transcript(s) HUMTREFAC_PEA_2_T4 (SEQ ID NO:13). An alignment is given to the known protein (Trefoil factor 3 precursor (SEQ ID NO:387)) at the end of the application. One or more alignments to one or more previously published protein sequences are given at the end of the application. A brief description of the relationship of the variant protein according to the present invention to each such aligned protein is as follows:

Comparison report between HUMTREFAC_PEA_2_P8 (SEQ ID NO:339) and TFF3_HUMAN:

1. An isolated chimeric polypeptide encoding for HUMTREFAC_PEA_2_P8 (SEQ ID NO:339), comprising a first amino acid sequence being at least 90% homologous to MAARALCMLGLVLALLSSSSAEEYVGL corresponding to amino acids 1-27 of TFF3_HUMAN, which also corresponds to amino acids 1-27 of HUMTREFAC_PEA_2_P8 (SEQ ID NO:339), and a second amino acid sequence being at least 70%, optionally at least 80%, preferably at least 85%, more preferably at least 90% and most preferably at least 95% homologous to a polypeptide having the sequence WKVHLPKGEGFSSG (SEQ ID NO: 543) corresponding to amino acids 28-41 of HUMTREFAC_PEA_2_P8 (SEQ ID NO:339), wherein said first amino acid sequence and second amino acid sequence are contiguous and in a sequential order.

2. An isolated polypeptide encoding for a tail of HUMTREFAC_PEA_2_P8 (SEQ ID NO:339), comprising a polypeptide being at least 70%, optionally at least about 80%, preferably at least about 85%, more preferably at least about 90% and most preferably at least about 95% homologous to the sequence WKVHLPKGEGFSSG (SEQ ID NO: 543) in HUMTREFAC_PEA_2_P8 (SEQ ID NO:339).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMTREFAC_PEA_2_P8 (SEQ ID NO:339) also has the following non-silent SNPs (Single Nucleotide Polymorphisms) as listed in Table 127, (given according to their position(s) on the amino acid sequence, with the alternative amino acid(s) listed; the last column indicates whether the SNP is known or not; the presence of known SNPs in variant protein HUMTREFAC_PEA_2_P8 (SEQ ID NO:339) sequence provides support for the deduced sequence of this variant protein according to the present invention).

TABLE 127

Amino acid mutations

| SNP position(s) on amino acid sequence | Alternative amino acid(s) | Previously known SNP? |
|---|---|---|
| 5 | A -> S | No |
| 5 | A -> T | No |
| 14 | A -> V | Yes |

Variant protein HUMTREFAC_PEA_2_P8 (SEQ ID NO:339) is encoded by the following transcript(s): HUMTREFAC_PEA_2_T4 (SEQ ID NO:13), for which the sequence(s) is/are given at the end of the application. The coding portion of transcript HUMTREFAC_PEA_2_T4 (SEQ ID NO:13) is shown in bold; this coding portion starts at position 278 and ends at position 400. The transcript also has the following SNPs as listed in Table 128 (given according to their position on the nucleotide sequence, with the alternative nucleic acid listed; the last column indicates whether the SNP is known or not; the presence of known SNPs in variant protein HUMTREFAC_PEA_2_P8 (SEQ ID NO:339) sequence provides support for the deduced sequence of this variant protein according to the present invention).

TABLE 128

Nucleic acid SNPs

| SNP position on nucleotide sequence | Alternative nucleic acid | Previously known SNP? |
|---|---|---|
| 233 | A -> G | Yes |
| 290 | G -> A | No |
| 290 | G -> T | No |
| 318 | C -> T | Yes |
| 515 | C -> A | No |
| 515 | C -> T | No |
| 566 | C -> T | Yes |
| 756 | C -> A | Yes |
| 796 | C -> T | No |
| 1265 | A -> C | No |
| 1266 | A -> T | No |

As noted above, cluster HUMTREFAC features 7 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMTREFAC_PEA_2_node_0 (SEQ ID NO:136) according to the present invention is supported by 188 libraries. The number of libraries was determined as previously described. This segment can be found in the following transcript(s): HUMTREFAC_PEA_2_T4 (SEQ ID NO:13) and HUMTREFAC_PEA_2_T5 (SEQ ID NO:14) Table 129 below describes the starting and ending position of this segment on each transcript.

TABLE 129

Segment location on transcripts

| Transcript name | Segment starting position | Segment ending position |
|---|---|---|
| HUMTREFAC_PEA_2_T4 (SEQ ID NO:13) | 1 | 359 |
| HUMTREFAC_PEA_2_T5 (SEQ ID NO:14) | 1 | 359 |

Segment cluster HUMTREFAC_PEA_2_node_9 (SEQ ID NO:137) according to the present invention is supported by 150 libraries. The number of libraries was determined as previously described. This segment can be found in the following transcript(s): HUMTREFAC_PEA_2_T4 (SEQ ID NO:13) and HUMTREFAC_PEA_2_T5 (SEQ ID NO:14) Table 130 below describes the starting and ending position of this segment on each transcript.

TABLE 130

Segment location on transcripts

| Transcript name | Segment starting position | Segment ending position |
|---|---|---|
| HUMTREFAC_PEA_2_T4 (SEQ ID NO:13) | 681 | 1266 |
| HUMTREFAC_PEA_2_T5 (SEQ ID NO:14) | 570 | 747 |

According to an optional embodiment of the present invention, short segments related to the above cluster are also provided. These segments are up to about 120 bp in length, and so are included in a separate description.

Segment cluster HUMTREFAC_PEA_2_node_2 (SEQ ID NO:138) according to the present invention is supported by 4 libraries. The number of libraries was determined as previously described. This segment can be found in the following transcript(s): HUMTREFAC_PEA_2_T4 (SEQ ID NO:13). Table 131 below describes the starting and ending position of this segment on each transcript.

TABLE 131

Segment location on transcripts

| Transcript name | Segment starting position | Segment ending position |
|---|---|---|
| HUMTREFAC_PEA_2_T4 (SEQ ID NO:13) | 360 | 470 |

Segment cluster HUMTREFAC_PEA_2_node_3 (SEQ ID NO:139) according to the present invention is supported by 10 libraries. The number of libraries was determined as previously described. This segment can be found in the following transcript(s): HUMTREFAC_PEA_2_T4 (SEQ ID NO:13) and HUMTREFAC_PEA_2_T5 (SEQ ID NO:14) Table 132 below describes the starting and ending position of this segment on each transcript.

TABLE 132

Segment location on transcripts

| Transcript name | Segment starting position | Segment ending position |
|---|---|---|
| HUMTREFAC_PEA_2_T4 (SEQ ID NO:13) | 471 | 514 |
| HUMTREFAC_PEA_2_T5 (SEQ ID NO:14) | 360 | 403 |

Segment cluster HUMTREFAC_PEA_2_node_4 (SEQ ID NO:140) according to the present invention is supported by 197 libraries. The number of libraries was determined as previously described. This segment can be found in the following transcript(s): HUMTREFAC_PEA_2_T4 (SEQ ID NO:13) and HUMTREFAC_PEA_2_T5 (SEQ ID NO:14) Table 133 below describes the starting and ending position of this segment on each transcript.

TABLE 133

Segment location on transcripts

| Transcript name | Segment starting position | Segment ending position |
|---|---|---|
| HUMTREFAC_PEA_2_T4 (SEQ ID NO:13) | 515 | 611 |
| HUMTREFAC_PEA_2_T5 (SEQ ID NO:14) | 404 | 500 |

Segment cluster HUMTREFAC_PEA_2_node_5 (SEQ ID NO:141) according to the present invention is supported by 187 libraries. The number of libraries was determined as previously described. This segment can be found in the following transcript(s): HUMTREFAC_PEA_2_T4 (SEQ ID NO:13) and HUMTREFAC_PEA_2_T5 (SEQ ID NO:14) Table 134 below describes the starting and ending position of this segment on each transcript.

TABLE 134

Segment location on transcripts

| Transcript name | Segment starting position | Segment ending position |
|---|---|---|
| HUMTREFAC_PEA_2_T4 (SEQ ID NO:13) | 612 | 661 |
| HUMTREFAC_PEA_2_T5 (SEQ ID NO:14) | 501 | 550 |

Segment cluster HUMTREFAC_PEA_2_node_8 (SEQ ID NO:142) according to the present invention can be found in the following transcript(s): HUMTREFAC_PEA_2_T4 (SEQ ID NO:13) and HUMTREFAC_PEA_2_T5 (SEQ ID NO:14). Table 135 below describes the starting and ending position of this segment on each transcript.

TABLE 135

Segment location on transcripts

| Transcript name | Segment starting position | Segment ending position |
|---|---|---|
| HUMTREFAC_PEA_2_T4 (SEQ ID NO:13) | 662 | 680 |
| HUMTREFAC_PEA_2_T5 (SEQ ID NO:14) | 551 | 569 |

Variant Protein Alignment to the Previously Known Protein:

```
Sequence name: TFF3_HUMAN
Sequence documentation:
Alignment of: HUMTREFAC_PEA_2_P8
  (SEQ ID NO:339) x TFF3_HUMAN . . .
Alignment segment 1/1:
 Quality:                         246.00
 Escore:                               0
 Matching length:                     27
 Total length:                        27
 Matching Percent Similarity:     100.00
 Matching Percent Identity:       100.00
 Total Percent Similarity:        100.00
 Total Percent Identity:          100.00
 Gaps:                                 0

Alignment:

1   MAARALCMLGLVLALLSSSSAEEYVGL   27
    |||||||||||||||||||||||||||
1   MAARALCMLGLVLALLSSSSAEEYVGL   27
```

Description for Cluster HSCOC4

Cluster HSCOC4 features 19 transcript(s) and 79 segment(s) of interest, the names for which are given in Tables 136 and 137, respectively, the sequences themselves are given at the end of the application. The selected protein variants are given in table 138.

TABLE 136

Transcripts of interest

| Transcript Name | Sequence ID No. |
|---|---|
| HSCOC4_PEA_1_T1 | 15 |
| HSCOC4_PEA_1_T2 | 16 |
| HSCOC4_PEA_1_T3 | 17 |

TABLE 136-continued

Transcripts of interest

| Transcript Name | Sequence ID No. |
|---|---|
| HSCOC4_PEA_1_T4 | 18 |
| HSCOC4_PEA_1_T5 | 19 |
| HSCOC4_PEA_1_T7 | 20 |
| HSCOC4_PEA_1_T8 | 21 |
| HSCOC4_PEA_1_T11 | 22 |
| HSCOC4_PEA_1_T12 | 23 |
| HSCOC4_PEA_1_T14 | 24 |
| HSCOC4_PEA_1_T15 | 25 |
| HSCOC4_PEA_1_T20 | 26 |
| HSCOC4_PEA_1_T21_( | 27 |
| HSCOC4_PEA_1_T25 | 28 |
| HSCOC4_PEA_1_T28 | 29 |
| HSCOC4_PEA_1_T30 | 30 |
| HSCOC4_PEA_1_T31 | 31 |
| HSCOC4_PEA_1_T32 | 32 |
| HSCOC4_PEA_1_T40 | 33 |

TABLE 137

Segments of interest

| Segment Name | Sequence ID No. |
|---|---|
| HSCOC4_PEA_1_node_1 | 143 |
| HSCOC4_PEA_1_node_5 | 144 |
| HSCOC4_PEA_1_node_7 | 145 |
| HSCOC4_PEA_1_node_30 | 146 |
| HSCOC4_PEA_1_node_33 | 147 |
| HSCOC4_PEA_1_node_35 | 148 |
| HSCOC4_PEA_1_node_37 | 149 |
| HSCOC4_PEA_1_node_39 | 150 |
| HSCOC4_PEA_1_node_43 | 151 |
| HSCOC4_PEA_1_node_48 | 152 |
| HSCOC4_PEA_1_node_49 | 153 |
| HSCOC4_PEA_1_node_51 | 154 |
| HSCOC4_PEA_1_node_58 | 155 |
| HSCOC4_PEA_1_node_59 | 156 |
| HSCOC4_PEA_1_node_62 | 157 |
| HSCOC4_PEA_1_node_66 | 158 |
| HSCOC4_PEA_1_node_72 | 159 |
| HSCOC4_PEA_1_node_77 | 160 |
| HSCOC4_PEA_1_node_79 | 161 |
| HSCOC4_PEA_1_node_93 | 162 |
| HSCOC4_PEA_1_node_100 | 163 |
| HSCOC4_PEA_1_node_105 | 164 |
| HSCOC4_PEA_1_node_107 | 165 |
| HSCOC4_PEA_1_node_108 | 166 |
| HSCOC4_PEA_1_node_109 | 167 |
| HSCOC4_PEA_1_node_110 | 168 |
| HSCOC4_PEA_1_node_112 | 169 |
| HSCOC4_PEA_1_node_113 | 170 |
| HSCOC4_PEA_1_node_2 | 171 |
| HSCOC4_PEA_1_node_8 | 172 |
| HSCOC4_PEA_1_node_10 | 173 |
| HSCOC4_PEA_1_node_12 | 174 |
| HSCOC4_PEA_1_node_14 | 175 |
| HSCOC4_PEA_1_node_17 | 176 |
| HSCOC4_PEA_1_node_19 | 177 |
| HSCOC4_PEA_1_node_21 | 178 |
| HSCOC4_PEA_1_node_22 | 179 |
| HSCOC4_PEA_1_node_28 | 180 |
| HSCOC4_PEA_1_node_29 | 181 |
| HSCOC4_PEA_1_node_41 | 182 |
| HSCOC4_PEA_1_node_45 | 183 |
| HSCOC4_PEA_1_node_47 | 184 |
| HSCOC4_PEA_1_node_50 | 185 |
| HSCOC4_PEA_1_node_53 | 186 |
| HSCOC4_PEA_1_node_55 | 187 |
| HSCOC4_PEA_1_node_57 | 188 |
| HSCOC4_PEA_1_node_60 | 189 |
| HSCOC4_PEA_1_node_64 | 190 |
| HSCOC4_PEA_1_node_69 | 191 |

TABLE 137-continued

Segments of interest

| Segment Name | Sequence ID No. |
|---|---|
| HSCOC4_PEA_1_node_70 | 192 |
| HSCOC4_PEA_1_node_71 | 193 |
| HSCOC4_PEA_1_node_73 | 194 |
| HSCOC4_PEA_1_node_74 | 195 |
| HSCOC4_PEA_1_node_75 | 196 |
| HSCOC4_PEA_1_node_76 | 197 |
| HSCOC4_PEA_1_node_78 | 198 |
| HSCOC4_PEA_1_node_80 | 199 |
| HSCOC4_PEA_1_node_82 | 200 |
| HSCOC4_PEA_1_node_83 | 201 |
| HSCOC4_PEA_1_node_84 | 202 |
| HSCOC4_PEA_1_node_85 | 203 |
| HSCOC4_PEA_1_node_86 | 204 |
| HSCOC4_PEA_1_node_87 | 205 |
| HSCOC4_PEA_1_node_88 | 206 |
| HSCOC4_PEA_1_node_89 | 207 |
| HSCOC4_PEA_1_node_90 | 208 |
| HSCOC4_PEA_1_node_91 | 209 |
| HSCOC4_PEA_1_node_92 | 210 |
| HSCOC4_PEA_1_node_94 | 211 |
| HSCOC4_PEA_1_node_96 | 212 |
| HSCOC4_PEA_1_node_97 | 213 |
| HSCOC4_PEA_1_node_98 | 214 |
| HSCOC4_PEA_1_node_99 | 215 |
| HSCOC4_PEA_1_node_101 | 216 |
| HSCOC4_PEA_1_node_102 | 217 |
| HSCOC4_PEA_1_node_103 | 218 |
| HSCOC4_PEA_1_node_104 | 219 |
| HSCOC4_PEA_1_node_106 | 220 |
| HSCOC4_PEA_1_node_111 | 221 |

TABLE 138

Proteins of interest

| Protein Name | Sequence ID No. | Corresponding Transcript(s) |
|---|---|---|
| HSCOC4_PEA_1_P3 | 340 | HSCOC4_PEA_1_T1 (SEQ ID NO:15) |
| HSCOC4_PEA_1_P5 | 341 | HSCOC4_PEA_1_T3 (SEQ ID NO:17) |
| HSCOC4_PEA_1_P6 | 342 | HSCOC4_PEA_1_T4 (SEQ ID NO:18) |
| HSCOC4_PEA_1_P12 | 343 | HSCOC4_PEA_1_T11 (SEQ ID NO:22) |
| HSCOC4_PEA_1_P15 | 344 | HSCOC4_PEA_1_T14 (SEQ ID NO:24) |
| HSCOC4_PEA_1_P16 | 345 | HSCOC4_PEA_1_T15 (SEQ ID NO:25) |
| HSCOC4_PEA_1_P20 | 346 | HSCOC4_PEA_1_T20 (SEQ ID NO:26) |
| HSCOC4_PEA_1_P9 | 347 | HSCOC4_PEA_1_T21 (SEQ ID NO:27) |
| HSCOC4_PEA_1_P22 | 348 | HSCOC4_PEA_1_T25 (SEQ ID NO:28) |
| HSCOC4_PEA_1_P23 | 349 | HSCOC4_PEA_1_T28 (SEQ ID NO:29) |
| HSCOC4_PEA_1_P24 | 350 | HSCOC4_PEA_1_T30 (SEQ ID NO:30) |
| HSCOC4_PEA_1_P25 | 351 | HSCOC4_PEA_1_T31 (SEQ ID NO:31) |
| HSCOC4_PEA_1_P26 | 352 | HSCOC4_PEA_1_T32 (SEQ ID NO:32) |
| HSCOC4_PEA_1_P30 | 353 | HSCOC4_PEA_1_T40 (SEQ ID NO:33) |
| HSCOC4_PEA_1_P38 | 354 | HSCOC4_PEA_1_T2 (SEQ ID NO:16) |
| HSCOC4_PEA_1_P39 | 355 | HSCOC4_PEA_1_T5 (SEQ ID NO:19) |
| HSCOC4_PEA_1_P40 | 356 | HSCOC4_PEA_1_T7 (SEQ ID NO:20) |
| HSCOC4_PEA_1_P41 | 357 | HSCOC4_PEA_1_T8 (SEQ ID NO:21) |
| HSCOC4_PEA_1_P42 | 358 | HSCOC4_PEA_1_T12 (SEQ ID NO:23) |

These sequences are variants of the known protein Complement C4 precursor [Contains: C4a anaphylatoxin] (SEQ ID NO:388) (SwissProt accession identifier CO4_HUMAN (SEQ ID NO: 388)), SEQ ID NO: 388, referred to herein as the previously known protein.

Protein Complement C4 precursor [Contains: C4a anaphylatoxin] (SEQ ID NO:388) is known or believed to have the following function(s): C4 plays a central role in the activation of the classical pathway of the complement system. It is processed by activated C1 which remove from the alpha chain the C4a anaphylatoxin; Derived from proteolytic degradation of complement C4, C4a anaphylatoxin is a mediator of local inflammatory process. It induces the contraction of smooth muscle, increases vascular permeability and causes histamine release from mast cells and basophilic leukocytes. The sequence for protein Complement C4 precursor [Contains: C4a anaphylatoxin] (SEQ ID NO:388) is given at the end of the application, as "Complement C4 precursor [Contains: C4a anaphylatoxin] (SEQ ID NO:388) amino acid sequence". Known polymorphisms for this sequence are as shown in Table 139.

TABLE 139

Amino acid mutations for Known Protein

| SNP position(s) on amino acid sequence | Comment |
|---|---|
| 477 | R -> W (in allotype C4A6). /FTId = VAR_001987. |
| 726 | P -> L (in allotype C4A3). /FTId = VAR_001988. |
| 1073 | D -> G (in allotype C4A1, allotype C4B1 and allotype C4B3). /FTId = VAR_001989. |
| 1120-1125 | PCPVLD -> LSPVIH (in allotype C4B). /FTId = VAR_001990. |
| 1176 | N -> S (in allotype C4A1, allotype C4B1, allotype C4B3 and allotype C4B5). /FTId = VAR_001991. |
| 1201 | S -> T (in allotype C4A6, allotype C4A3, allotype C4A1 and allotype C4B). /FTId = VAR_001992. |
| 1207 | V -> A (in allotype C4A1, allotype C4B1, allotype C4B2 and allotype C4B3). /FTId = VAR_001993. |
| 1210 | L -> R (in allotype C4A1, allotype C4B1, allotype C4B2 and allotype C4B3). /FTId = VAR_001994. |
| 1286 | S -> A (in allotype C4A6, allotype C4A1, allotype C4A3A and allotype C4B). /FTId = VAR_001995. |
| 1-12 | MRLLWGLIWASS -> PREVRSVCLSAT |
| 347 | S -> Y |
| 418 | V -> A |
| 727 | D -> N |
| 907 | A -> T |
| 980-981 | VT -> LQ |
| 1013 | Q -> E |
| 1317 | I -> F |
| 1418-1420 | Missing |
| 1654 | T -> RA |
| 1698 | H -> Q |

The following GO Annotation(s) apply to the previously known protein. The following annotation(s) were found: muscle contraction regulation; inflammatory response; complement activation; complement activation, classical pathway, which are annotation(s) related to Biological Process; complement component; proteinase inhibitor, which are annotation(s) related to Molecular Function; and extracellular; extracellular space, which are annotation(s) related to Cellular Component.

The GO assignment relies on information from one or more of the SwissProt/TremB1 Protein knowledgebase, available from expasydot ch/sprot/; or Locuslink, available from ncbidot nlmdot nihdot gov/projects/LocusLink/.

Cluster HSCOC4 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 12 refer to weighted expression of ESTs in each category, as "parts per million" (ratio of the expression of ESTs for a particular cluster to the expression of all ESTs in that category, according to parts per million).

Figure 12:
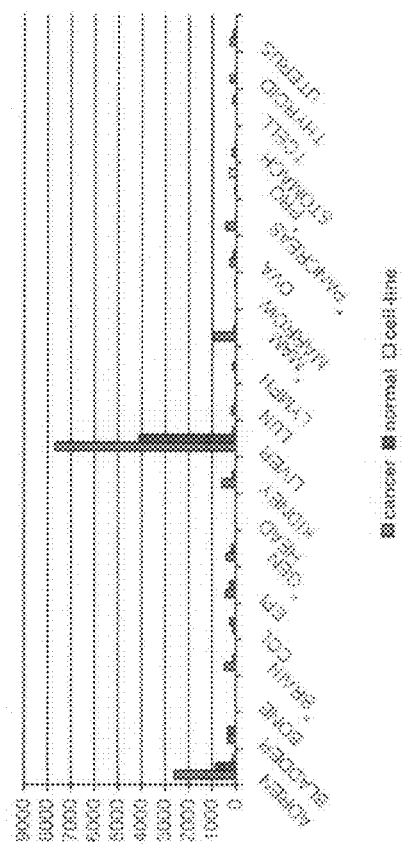
FIG. 12 is a histogram showing Cancer and cell-line vs. normal tissue expression for Cluster HSCOC4, demonstrating overexpression in brain malignant tumors, a mixture of malignant tumors from different tissues, breast malignant tumors, pancreas carcinoma and prostate cancer.

Overall, the following results were obtained as shown with regard to the histograms in FIG. 12 and Table 140. This cluster is overexpressed (at least at a minimum level) in the following pathological conditions: brain malignant tumors, a mixture of malignant tumors from different tissues, breast malignant tumors, pancreas carcinoma and prostate cancer.

TABLE 140

Normal tissue distribution

| Name of Tissue | Number |
|---|---|
| Adrenal | 853 |
| Bladder | 328 |
| Bone | 6 |
| Brain | 111 |
| Colon | 245 |
| Epithelial | 264 |
| General | 163 |
| head and neck | 0 |
| Kidney | 141 |
| Liver | 4109 |
| Lung | 64 |
| Lymph nodes | 120 |
| Breast | 96 |
| bone marrow | 0 |
| Ovary | 116 |
| Pancreas | 20 |
| Prostate | 4 |
| Stomach | 36 |
| T cells | 0 |
| Thyroid | 12 |
| Uterus | 127 |

TABLE 141

P values and ratios for expression in cancerous tissue

| Name of Tissue | P1 | P2 | SP1 | R3 | SP2 | R4 |
|---|---|---|---|---|---|---|
| Adrenal | 5.6e-01 | 5.9e-01 | 2.5e-06 | 0.3 | 4.3e-04 | 0.3 |
| Bladder | 5.0e-01 | 6.6e-01 | 6.3e-01 | 0.9 | 9.1e-01 | 0.6 |
| Bone | 5.5e-01 | 5.8e-01 | 1 | 1.1 | 7.0e-01 | 1.3 |
| Brain | 4.6e-03 | 6.2e-02 | 7.7e-11 | 3.0 | 3.2e-05 | 1.7 |
| Colon | 8.0e-01 | 8.3e-01 | 9.8e-01 | 0.4 | 9.9e-01 | 0.4 |
| Epithelial | 1.7e-01 | 9.2e-01 | 9.3e-07 | 1.3 | 9.7e-01 | 0.7 |
| General | 3.2e-04 | 6.1e-01 | 1.5e-31 | 2.1 | 1.9e-03 | 1.1 |
| head and neck | 1.2e-01 | 2.1e-01 | 1 | 1.2 | 1 | 1.1 |
| Kidney | 6.9e-01 | 8.1e-01 | 1.2e-01 | 2.4 | 1.5e-02 | 1.5 |
| Liver | 7.1e-01 | 7.2e-01 | 5.0e-04 | 0.2 | 1 | 0.1 |
| Lung | 2.9e-01 | 7.1e-01 | 4.2e-02 | 1.7 | 5.1e-01 | 0.8 |
| Lymph nodes | 6.3e-01 | 8.2e-01 | 9.0e-01 | 0.5 | 1 | 0.3 |
| Breast | 4.0e-02 | 1.8e-01 | 2.1e-06 | 6.0 | 3.9e-03 | 3.0 |

TABLE 141-continued

P values and ratios for expression in cancerous tissue

| Name of Tissue | P1 | P2 | SP1 | R3 | SP2 | R4 |
|---|---|---|---|---|---|---|
| bone marrow | 1 | 6.7e-01 | 1 | 1.0 | 2.8e-01 | 2.8 |
| Ovary | 6.6e-01 | 7.3e-01 | 1.3e-01 | 1.5 | 3.6e-01 | 1.1 |
| Pancreas | 1.7e-02 | 9.9e-02 | 4.8e-10 | 7.6 | 2.9e-07 | 5.1 |
| Prostate | 5.8e-01 | 6.3e-01 | 4.1e-02 | 3.9 | 1.8e-03 | 3.8 |
| Stomach | 2.7e-01 | 7.5e-01 | 1.1e-01 | 1.5 | 6.5e-01 | 0.8 |
| T cells | 1 | 6.7e-01 | 1 | 1.0 | 7.2e-01 | 1.4 |
| Thyroid | 3.4e-01 | 3.4e-01 | 3.0e-01 | 2.2 | 3.0e-01 | 2.2 |
| Uterus | 1.2e-01 | 5.3e-01 | 6.6e-02 | 1.4 | 5.4e-01 | 0.8 |

As noted above, cluster HSCOC4 features 19 transcript(s), which were listed in Table 136 above. These transcript(s) encode for protein(s) which are variant(s) of protein Complement C4 precursor [Contains: C4a anaphylatoxin]. A description of each variant protein according to the present invention is now provided.

Variant protein HSCOC4_PEA_1_P3 (SEQ ID NO:340) according to the present invention has an amino acid sequence as given at the end of the application; it is encoded by transcript(s) HSCOC4_PEA_1_T1 (SEQ ID NO:15). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P3 (SEQ ID NO:340) and CO4_HUMAN:

1. An isolated chimeric polypeptide encoding for HSCOC4_PEA_1_P3 (SEQ ID NO:340) comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTV corresponding to amino acids 1-865 of CO4_HUMAN, which also corresponds to amino acids 1-865 of HSCOC4_PEA_1_P3 (SEQ ID NO:340), and a second amino acid sequence being at least 70%, optionally at least 80%, preferably at least 85%, more preferably at least 90% and most preferably at least 95% homologous to a polypeptide having the sequence RPHRSLSIQELGEPGP-SEGWGG (SEQ ID NO:544) corresponding to amino acids 866-887 of HSCOC4_PEA_1_P3 (SEQ ID NO:340) wherein said first amino acid sequence and second amino acid sequence are contiguous and in a sequential order.

2. An isolated polypeptide encoding for a tail of HSCOC4_PEA_1_P3 (SEQ ID NO:340), comprising a polypeptide being at least 70%, optionally at least about 80%, preferably at least about 85%, more preferably at least about 90% and most preferably at least about 95% homologous to the sequence RPHRSLSIQELGEPGPSEGWGG (SEQ ID NO: 544) in HSCOC4_PEA_1_P3 (SEQ ID NO:340).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA_1_P3 (SEQ ID NO:340) also has the following non-silent SNPs (Single Nucleotide Polymorphisms) as listed in Table 142, (given according to their position(s) on the amino acid sequence, with the alternative amino acid(s) listed; the last column indicates whether the SNP is known or not; the presence of known SNPs in variant protein HSCOC4_PEA_1_P3 (SEQ ID NO:340) sequence provides support for the deduced sequence of this variant protein according to the present invention).

TABLE 142

Amino acid mutations

| SNP position(s) on amino acid sequence | Alternative amino acid(s) | Previously known SNP? |
|---|---|---|
| 128 | Q -> | No |
| 141 | L -> V | Yes |
| 183 | G -> | No |
| 211 | G -> | No |
| 322 | A -> | No |
| 322 | A -> V | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |
| 726 | P -> L | Yes |
| 869 | R -> G | Yes |

The glycosylation sites of variant protein HSCOC4_PEA_1_P3 (SEQ ID NO:340), as compared to the known protein Complement C4 precursor [Contains: C4a anaphylatoxin], are described in Table 143 (given according to their position(s) on the amino acid sequence in the first column; the second column indicates whether the glycosylation site is present in the variant protein; and the last column indicates whether the position is different on the variant protein).

TABLE 143

Glycosylation site(s)

| Position(s) on known amino acid sequence | Present in variant protein? | Position in variant protein? |
|---|---|---|
| 1391 | No | |
| 862 | Yes | 862 |
| 226 | Yes | 226 |
| 1328 | No | |

The phosphorylation sites of variant protein HSCOC4_PEA_1_P3 (SEQ ID NO:340), as compared to the known protein Complement C4 precursor [Contains: C4a anaphylatoxin], are described in Table 144 (given according to their position(s) on the amino acid sequence in the first column; the second column indicates whether the phosphorylation site is present in the variant protein; and the last column indicates whether the position is different on the variant protein).

TABLE 144

Phosphorylation site(s)

| Position(s) on known amino acid sequence | Present in variant protein? | Position in variant protein? |
|---|---|---|
| 1420 | No | |
| 1422 | No | |
| 1417 | No | |

Variant protein HSCOC4_PEA_1_P3 (SEQ ID NO:340) is encoded by the following transcript(s): HSCOC4_PEA_1_T1 (SEQ ID NO:15), for which the sequence(s) is/are given at the end of the application. The coding portion of transcript HSCOC4_PEA_1_T1 (SEQ ID NO:15) is shown in bold; this coding portion starts at position 501 and ends at position 3161. The transcript also has the following SNPs as listed in Table 145 (given according to their position on the nucleotide sequence, with the alternative nucleic acid listed; the last column indicates whether the SNP is known or not; the presence of known SNPs in variant protein HSCOC4_PEA_1_P3 (SEQ ID NO:340) sequence provides support for the deduced sequence of this variant protein according to the present invention).

TABLE 145

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |

TABLE 145-continued

Nucleic acid SNPs

| SNP position on nucleotide sequence | Alternative nucleic acid | Previously known SNP? |
| --- | --- | --- |
| 2435 | G -> A | Yes |
| 2540 | C -> T | No |
| 2677 | C -> T | Yes |
| 2975 | C -> T | Yes |
| 3105 | A -> G | Yes |
| 3167 | G -> A | Yes |
| 3228 | T -> C | Yes |
| 3259 | G -> T | Yes |
| 3332 | G -> A | Yes |
| 3490 | A -> C | Yes |
| 3569 | T -> C | Yes |
| 3724 | G -> T | Yes |
| 3831 | A -> G | Yes |
| 3898 | C -> A | Yes |
| 3972 | C -> T | Yes |
| 3975 | G -> C | Yes |
| 3983 | T -> A | Yes |
| 3986 | G -> C | Yes |
| 3988 | C -> T | Yes |
| 4140 | G -> A | Yes |
| 4147 | T -> C | Yes |
| 4228 | C -> G | Yes |
| 4233 | C -> T | Yes |
| 4242 | G -> T | Yes |
| 4243 | G -> C | Yes |
| 4339 | G -> A | Yes |
| 4345 | C -> G | Yes |
| 4348 | G -> A | Yes |
| 4469 | G -> T | Yes |
| 4562 | A -> T | Yes |
| 4781 | A -> G | No |
| 4873 | T -> C | Yes |
| 5007 | G -> | No |
| 5423 | C -> G | Yes |
| 5634 | G -> C | No |
| 5677 | G -> A | Yes |
| 5687 | A -> C | Yes |
| 5862 | A -> C | Yes |
| 5868 | G -> A | Yes |
| 5933 | A -> C | Yes |

Variant protein HSCOC4_PEA_1_P5 (SEQ ID NO:341) according to the present invention has an amino acid sequence as given at the end of the application; it is encoded by transcript(s) HSCOC4_PEA_1_T3 (SEQ ID NO:17). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P5 (SEQ ID NO:341) and CO4_HUMAN:

1. An isolated chimeric polypeptide encoding for HSCOC4_PEA_1_P5 (SEQ ID NO:341) comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKG corresponding to amino acids 1-818 of CO4_HUMAN, which also corresponds to amino acids 1-818 of HSCOC4_PEA_1_P5 (SEQ ID NO:341), and a second amino acid sequence being at least 70%, optionally at least 80%, preferably at least 85%, more preferably at least 90% and most preferably at least 95% homologous to a polypeptide having the sequence DVTLSGPQVTLLPFPCTPAPCSLCS (SEQ ID NO: 545) corresponding to amino acids 819-843 of HSCOC4_PEA_1_P5 (SEQ ID NO:341), wherein said first amino acid sequence and second amino acid sequence are contiguous and in a sequential order.

2. An isolated polypeptide encoding for a tail of HSCOC4_PEA_1_P5 (SEQ ID NO:341), comprising a polypeptide being at least 70%, optionally at least about 80%, preferably at least about 85%, more preferably at least about 90% and most preferably at least about 95% homologous to the sequence DVTLSGPQVTLLPFPCTPAPCSLCS (SEQ ID NO: 545) in HSCOC4_PEA_1_P5 (SEQ ID NO:341).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA_1_P5 (SEQ ID NO:341) also has the following non-silent SNPs (Single Nucleotide Polymorphisms) as listed in Table 146, (given according to their position(s) on the amino acid sequence, with the alternative amino acid(s) listed; the last column indicates whether the SNP is known or not; the presence of known SNPs in variant protein HSCOC4_PEA_1_P5 (SEQ ID NO:341) sequence provides support for the deduced sequence of this variant protein according to the present invention).

TABLE 146

Amino acid mutations

| SNP position(s) on amino acid sequence | Alternative amino acid(s) | Previously known SNP? |
| --- | --- | --- |
| 128 | Q -> | No |
| 141 | L -> V | Yes |

TABLE 146-continued

Amino acid mutations

| SNP position(s) on amino acid sequence | Alternative amino acid(s) | Previously known SNP? |
|---|---|---|
| 183 | G -> | No |
| 211 | G -> | No |
| 322 | A -> | No |
| 322 | A -> V | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |
| 726 | P -> L | Yes |
| 829 | L -> P | Yes |
| 830 | L -> I | Yes |
| 840 | S -> P | Yes |

The glycosylation sites of variant protein HSCOC4_PEA_1_P5 (SEQ ID NO:341), as compared to the known protein Complement C4 precursor [Contains: C4a anaphylatoxin], are described in Table 147 (given according to their position(s) on the amino acid sequence in the first column; the second column indicates whether the glycosylation site is present in the variant protein; and the last column indicates whether the position is different on the variant protein).

TABLE 147

Glycosylation site(s)

| Position(s) on known amino acid sequence | Present in variant protein? | Position in variant protein? |
|---|---|---|
| 1391 | No | |
| 862 | No | |
| 226 | Yes | 226 |
| 1328 | No | |

The phosphorylation sites of variant protein HSCOC4_PEA_1_P5 (SEQ ID NO:341), as compared to the known protein Complement C4 precursor [Contains: C4a anaphylatoxin], are described in Table 148 (given according to their position(s) on the amino acid sequence in the first column; the second column indicates whether the phosphorylation site is present in the variant protein; and the last column indicates whether the position is different on the variant protein).

TABLE 148

Phosphorylation site(s)

| Position(s) on known amino acid sequence | Present in variant protein? | Position in variant protein? |
|---|---|---|
| 1420 | No | |
| 1422 | No | |
| 1417 | No | |

Variant protein HSCOC4_PEA_1_P5 (SEQ ID NO:341) is encoded by the following transcript(s): HSCOC4_PEA_1_T3 (SEQ ID NO:17), for which the sequence(s) is/are given at the end of the application. The coding portion of transcript HSCOC4_PEA_1_T3 (SEQ ID NO:17) is shown in bold; this coding portion starts at position 501 and ends at position 3029. The transcript also has the following SNPs as listed in Table 149 (given according to their position on the nucleotide sequence, with the alternative nucleic acid listed; the last column indicates whether the SNP is known or not; the presence of known SNPs in variant protein HSCOC4_PEA_1_P5 (SEQ ID NO:341) sequence provides support for the deduced sequence of this variant protein according to the present invention).

TABLE 149

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |
| 2435 | G -> A | Yes |
| 2540 | C -> T | No |
| 2677 | C -> T | Yes |
| 2986 | T -> C | Yes |
| 2988 | C -> A | Yes |
| 3018 | T -> C | Yes |
| 3070 | C -> T | Yes |
| 3081 | C -> A | Yes |
| 3093 | A -> G | Yes |
| 3101 | G -> A | Yes |
| 3106 | G -> A | Yes |
| 3174 | G -> A | Yes |
| 3193 | A -> G | Yes |
| 3201 | T -> C | Yes |
| 3233 | C -> T | Yes |
| 3363 | A -> G | Yes |
| 3425 | G -> A | Yes |
| 3486 | T -> C | Yes |
| 3517 | G -> T | Yes |
| 3590 | G -> A | Yes |
| 3748 | A -> C | Yes |
| 3827 | T -> C | Yes |
| 3982 | G -> T | Yes |
| 4089 | A -> G | Yes |
| 4156 | C -> A | Yes |
| 4230 | C -> T | Yes |
| 4233 | G -> C | Yes |
| 4241 | T -> A | Yes |
| 4244 | G -> C | Yes |
| 4246 | C -> T | Yes |
| 4398 | G -> A | Yes |
| 4405 | T -> C | Yes |
| 4486 | C -> G | Yes |
| 4491 | C -> T | Yes |
| 4500 | G -> T | Yes |
| 4501 | G -> C | Yes |
| 4597 | G -> A | Yes |
| 4603 | C -> G | Yes |
| 4606 | G -> A | Yes |
| 4727 | G -> T | Yes |
| 4820 | A -> T | Yes |
| 5039 | A -> G | No |
| 5131 | T -> C | Yes |
| 5265 | G -> | No |
| 5681 | C -> G | Yes |
| 5892 | G -> C | No |
| 5935 | G -> A | Yes |
| 5945 | A -> C | Yes |

TABLE 149-continued

Nucleic acid SNPs

| SNP position on nucleotide sequence | Alternative nucleic acid | Previously known SNP? |
|---|---|---|
| 6120 | A -> C | Yes |
| 6126 | G -> A | Yes |
| 6191 | A -> C | Yes |

Variant protein HSCOC4_PEA_1_P6 (SEQ ID NO:342) according to the present invention has an amino acid sequence as given at the end of the application; it is encoded by transcript(s) HSCOC4_PEA_1_T4 (SEQ ID NO:18). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P6 (SEQ ID NO:342) and CO4_HUMAN:

1. An isolated chimeric polypeptide encoding for HSCOC4_PEA_1_P6 (SEQ ID NO:342) comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDTI TVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKG corresponding to amino acids 1-1052 of CO4_HUMAN, which also corresponds to amino acids 1-1052 of HSCOC4_PEA_1_P6 (SEQ ID NO:342), and a second amino acid sequence being at least 70%, optionally at least 80%, preferably at least 85%, more preferably at least 90% and most preferably at least 95% homologous to a polypeptide having the sequence SGCK-GKQEGGQERTVTGRWTAQEATEGKKGGP (SEQ ID NO: 546) corresponding to amino acids 1053-1084 of HSCOC4_PEA_1_P6 (SEQ ID NO:342), wherein said first amino acid sequence and second amino acid sequence are contiguous and in a sequential order.

2. An isolated polypeptide encoding for a tail of HSCOC4_PEA_1_P6 (SEQ ID NO:342), comprising a polypeptide being at least 70%, optionally at least about 80%, preferably at least about 85%, more preferably at least about 90% and most preferably at least about 95% homologous to the sequence SGCKGKQEGGQERTVTGR-WTAQEATEGKKGGP (SEQ ID NO: 546) in HSCOC4_PEA_1_P6 (SEQ ID NO:342).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA_1_P6 (SEQ ID NO:342) also has the following non-silent SNPs (Single Nucleotide Polymorphisms) as listed in Table 150, (given according to their position(s) on the amino acid sequence, with the alternative amino acid(s) listed; the last column indicates whether the SNP is known or not; the presence of known SNPs in variant protein HSCOC4_PEA_1_P6 (SEQ ID NO:342) sequence provides support for the deduced sequence of this variant protein according to the present invention).

TABLE 150

Amino acid mutations

| SNP position(s) on amino acid sequence | Alternative amino acid(s) | Previously known SNP? |
|---|---|---|
| 128 | Q -> | No |
| 141 | L -> V | Yes |
| 183 | G -> | No |
| 211 | G -> | No |
| 322 | A -> | No |
| 322 | A -> V | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |
| 726 | P -> L | Yes |
| 872 | V -> A | Yes |
| 907 | A -> T | Yes |
| 959 | E -> D | Yes |
| 1062 | G -> V | Yes |
| 1068 | T -> | Yes |

The glycosylation sites of variant protein HSCOC4_PEA_1_P6 (SEQ ID NO:342), as compared to the known protein Complement C4 precursor [Contains: C4a anaphylatoxin], are described in Table 151 (given according to their position(s) on the amino acid sequence in the first column; the second column indicates whether the glycosylation site is present in the variant protein; and the last column indicates whether the position is different on the variant protein).

TABLE 151

Glycosylation site(s)

| Position(s) on known amino acid sequence | Present in variant protein? | Position in variant protein? |
|---|---|---|
| 1391 | No | |
| 862 | Yes | 862 |
| 226 | Yes | 226 |
| 1328 | No | |

The phosphorylation sites of variant protein HSCOC4_PEA_1_P6 (SEQ ID NO:342), as compared to the known protein Complement C4 precursor [Contains: C4a anaphylatoxin], are described in Table 152 (given according to their position(s) on the amino acid sequence in the first column; the second column indicates whether the phosphorylation site is present in the variant protein; and the last column indicates whether the position is different on the variant protein).

TABLE 152

Phosphorylation site(s)

| Position(s) on known amino acid sequence | Present in variant protein? | Position in variant protein? |
|---|---|---|
| 1420 | No | |
| 1422 | No | |
| 1417 | No | |

Variant protein HSCOC4_PEA_1_P6 (SEQ ID NO:342) is encoded by the following transcript(s): HSCOC4_PEA_1_T4 (SEQ ID NO:18), for which the sequence(s) is/are given at the end of the application. The coding portion of transcript HSCOC4_PEA_1_T4 (SEQ ID NO:18) is shown in bold; this coding portion starts at position 501 and ends at position 3752. The transcript also has the following SNPs as listed in Table 153 (given according to their position on the nucleotide sequence, with the alternative nucleic acid listed; the last column indicates whether the SNP is known or not; the presence of known SNPs in variant protein HSCOC4_PEA_1_P6 (SEQ ID NO:342) sequence provides support for the deduced sequence of this variant protein according to the present invention).

TABLE 153

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |

TABLE 153-continued

Nucleic acid SNPs

| SNP position on nucleotide sequence | Alternative nucleic acid | Previously known SNP? |
|---|---|---|
| 2435 | G -> A | Yes |
| 2540 | C -> T | No |
| 2677 | C -> T | Yes |
| 2975 | C -> T | Yes |
| 3115 | T -> C | Yes |
| 3146 | G -> T | Yes |
| 3219 | G -> A | Yes |
| 3377 | A -> C | Yes |
| 3456 | T -> C | Yes |
| 3611 | G -> T | Yes |
| 3685 | G -> T | Yes |
| 3702 | A -> | Yes |
| 3897 | A -> G | Yes |
| 3964 | C -> A | Yes |
| 4038 | C -> T | Yes |
| 4041 | G -> C | Yes |
| 4049 | T -> A | Yes |
| 4052 | G -> C | Yes |
| 4054 | C -> T | Yes |
| 4206 | G -> A | Yes |
| 4213 | T -> C | Yes |
| 4294 | C -> G | Yes |
| 4299 | C -> T | Yes |
| 4308 | G -> T | Yes |
| 4309 | G -> C | Yes |
| 4405 | G -> A | Yes |
| 4411 | C -> G | Yes |
| 4414 | G -> A | Yes |
| 4535 | G -> T | Yes |
| 4628 | A -> T | Yes |
| 4847 | A -> G | No |
| 4939 | T -> C | Yes |
| 5073 | G -> | No |
| 5489 | C -> G | Yes |
| 5700 | G -> C | No |
| 5743 | G -> A | Yes |
| 5753 | A -> C | Yes |
| 5928 | A -> C | Yes |
| 5934 | G -> A | Yes |
| 5999 | A -> C | Yes |

Variant protein HSCOC4_PEA_1_P12 (SEQ ID NO:343) according to the present invention has an amino acid sequence as given at the end of the application; it is encoded by transcript(s) HSCOC4_PEA_1_T11 (SEQ ID NO:22). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P12 (SEQ ID NO:343) and CO4_HUMAN_V1 (SEQ ID NO:389):

1. An isolated chimeric polypeptide encoding for HSCOC4_PEA_1_P12 (SEQ ID NO:343), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDTI TVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY- IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSV SVFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYAAWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGNSKGTLKV corresponding to amino acids 1-1380 of CO4_HUMAN_V1 (SEQ ID NO:389), which also corresponds to amino acids 1-1380 of HSCOC4_PEA_1_P12 (SEQ ID NO:343), and a second amino acid sequence being at least 70%, optionally at least 80%, preferably at least 85%, more preferably at least 90% and most preferably at least 95% homologous to a polypeptide having the sequence RAREGVG-PGTGGGEGVE (SEQ ID NO: 547) corresponding to amino acids 1381-1397 of HSCOC4_PEA_1_P12 (SEQ ID NO:343), wherein said first amino acid sequence and second amino acid sequence are contiguous and in a sequential order.

2. An isolated polypeptide encoding for a tail of HSCOC4_PEA_1_P12 (SEQ ID NO:343), comprising a polypeptide being at least 70%, optionally at least about 80%, preferably at least about 85%, more preferably at least about 90% and most preferably at least about 95% homologous to the sequence RAREGVGPGTGGGEGVE (SEQ ID NO: 547) in HSCOC4_PEA_1_P12 (SEQ ID NO:343).

It should be noted that the known protein sequence (CO4_HUMAN) has one or more changes than the sequence given at the end of the application and named as being the amino acid sequence for CO4_HUMAN_V1 (SEQ ID NO:389). These changes were previously known to occur and are listed in the table below.

TABLE 154

Changes to CO4_HUMAN_V1 (SEQ ID NO:389)

| SNP position(s) on amino acid sequence | Type of change |
|---|---|
| 1177 | Variant |
| 1202 | Variant |
| 1208 | Variant |
| 1211 | Variant |
| 1287 | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA_1_P12 (SEQ ID NO:343) also has the following non-silent SNPs (Single Nucleotide Polymorphisms) as listed in Table 155, (given according to their position(s) on the amino acid sequence, with the alternative amino acid(s) listed; the last column indicates whether the SNP is known or not; the presence of known SNPs in variant protein HSCOC4_PEA_1_P12 (SEQ ID NO:343) sequence provides support for the deduced sequence of this variant protein according to the present invention).

TABLE 155

Amino acid mutations

| SNP position(s) on amino acid sequence | Alternative amino acid(s) | Previously known SNP? |
|---|---|---|
| 128 | Q -> | No |
| 141 | L -> V | Yes |
| 183 | G -> | No |
| 211 | G -> | No |
| 322 | A -> | No |
| 322 | A -> V | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |
| 726 | P -> L | Yes |
| 872 | V -> A | Yes |
| 907 | A -> T | Yes |
| 959 | E -> D | Yes |
| 1073 | D -> G | Yes |
| 1120 | P -> L | Yes |
| 1121 | C -> S | Yes |
| 1124 | L -> I | Yes |
| 1125 | D -> H | Yes |
| 1176 | S -> N | Yes |
| 1207 | A -> V | Yes |
| 1210 | R -> L | Yes |
| 1286 | A -> S | Yes |
| 1317 | I -> F | Yes |

Variant protein HSCOC4_PEA_1_P12 (SEQ ID NO:343) is encoded by the following transcript(s): HSCOC4_PEA_1_T11 (SEQ ID NO:22), for which the sequence(s) is/are given at the end of the application. The coding portion of transcript HSCOC4_PEA_1_T11 (SEQ ID NO:22) is shown in bold; this coding portion starts at position 501 and ends at position 4691. The transcript also has the following SNPs as listed in Table 156 (given according to their position on the nucleotide sequence, with the alternative nucleic acid listed; the last column indicates whether the SNP is known or not; the presence of known SNPs in variant protein HSCOC4_PEA_1_P12 (SEQ ID NO:343) sequence provides support for the deduced sequence of this variant protein according to the present invention).

TABLE 156

| Nucleic acid SNPs | | |
|---|---|---|
| SNP position on nucleotide sequence | Alternative nucleic acid | Previously known SNP? |
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |
| 2435 | G -> A | Yes |
| 2540 | C -> T | No |
| 2677 | C -> T | Yes |
| 2975 | C -> T | Yes |
| 3115 | T -> C | Yes |
| 3146 | G -> T | Yes |
| 3219 | G -> A | Yes |
| 3377 | A -> C | Yes |
| 3456 | T -> C | Yes |
| 3611 | G -> T | Yes |
| 3718 | A -> G | Yes |
| 3785 | C -> A | Yes |
| 3859 | C -> T | Yes |
| 3862 | G -> C | Yes |
| 3870 | T -> A | Yes |
| 3873 | G -> C | Yes |
| 3875 | C -> T | Yes |
| 4027 | G -> A | Yes |
| 4034 | T -> C | Yes |
| 4115 | C -> G | Yes |
| 4120 | C -> T | Yes |
| 4129 | G -> T | Yes |
| 4130 | G -> C | Yes |
| 4226 | G -> A | Yes |
| 4232 | C -> G | Yes |
| 4235 | G -> A | Yes |
| 4356 | G -> T | Yes |
| 4449 | A -> T | Yes |
| 4859 | C -> T | Yes |
| 4876 | C -> A | Yes |
| 4882 | C -> G | Yes |
| 4924 | G -> A | Yes |
| 5205 | C -> G | Yes |
| 5596 | C -> T | Yes |
| 5717 | A -> G | No |
| 5809 | T -> C | Yes |
| 5943 | G -> | No |
| 6359 | C -> G | Yes |
| 6570 | G -> C | No |
| 6613 | G -> A | Yes |
| 6623 | A -> C | Yes |
| 6798 | A -> C | Yes |

TABLE 156-continued

| Nucleic acid SNPs | | |
|---|---|---|
| SNP position on nucleotide sequence | Alternative nucleic acid | Previously known SNP? |
| 6804 | G -> A | Yes |
| 6869 | A -> C | Yes |

Variant protein HSCOC4_PEA_1_P15 (SEQ ID NO:344) according to the present invention has an amino acid sequence as given at the end of the application; it is encoded by transcript(s) HSCOC4_PEA_1_T14 (SEQ ID NO:24). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P15 (SEQ ID NO:344) and CO4_HUMAN_V1 (SEQ ID NO:389):

1. An isolated chimeric polypeptide encoding for HSCOC4_PEA_1_P15 (SEQ ID NO:344), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSV SVFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYAAWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQ corresponding to amino acids 1-1359 of CO4_HUMAN_V1 (SEQ ID NO:389), which also corresponds to amino acids 1-1359 of HSCOC4_PEA_1_P15 (SEQ ID NO:344), and a second amino acid sequence being at least 70%, optionally at least 80%, preferably at least 85%, more preferably at least 90% and most preferably at least 95% homologous to a polypeptide having the sequence VNHSLVNHSLAWVARTPGPRGQARSR-PQPPTRGIPAALLPGVFGGRLTSWLRDLEL (SEQ ID NO: 548) corresponding to amino acids 1360-1415 of HSCOC4_PEA_1_P15 (SEQ ID NO:344), wherein said first amino acid sequence and second amino acid sequence are contiguous and in a sequential order.

2. An isolated polypeptide encoding for a tail of HSCOC4_PEA_1_P15 (SEQ ID NO:344) comprising a polypeptide being at least 70%, optionally at least about 80%, preferably at least about 85%, more preferably at least about 90% and most preferably at least about 95% homologous to the sequence VNHSLVNHSLAWVARTPG-PRGQARSRPQPPTRGIPAALLPGVFGGR-LTSWLRDLEL in (SEQ ID NO: 548) HSCOC4_PEA_1_P15 (SEQ ID NO:344).

It should be noted that the known protein sequence (CO4_HUMAN) has one or more changes than the sequence given at the end of the application and named as being the amino acid sequence for CO4_HUMAN_V1 (SEQ ID NO:389). These changes were previously known to occur and are listed in the table below.

TABLE 157

| Changes to CO4_HUMAN_V1 (SEQ ID NO: 389) | |
|---|---|
| SNP position(s) on amino acid sequence | Type of change |
| 1177 | Variant |
| 1202 | Variant |
| 1208 | Variant |
| 1211 | Variant |
| 1287 | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA_1_P15 (SEQ ID NO:344) also has the following non-silent SNPs (Single Nucleotide Polymorphisms) as listed in Table 158, (given according to their position(s) on the amino acid sequence, with the alternative amino acid(s) listed; the last column indicates whether the SNP is known or not; the presence of known SNPs in variant protein HSCOC4_PEA_1_P15 (SEQ ID NO:344) sequence provides support for the deduced sequence of this variant protein according to the present invention).

TABLE 158

| Amino acid mutations | | |
|---|---|---|
| SNP position(s) on amino acid sequence | Alternative amino acid(s) | Previously known SNP? |
| 128 | Q -> | No |
| 141 | L -> V | Yes |
| 183 | G -> | No |
| 211 | G -> | No |
| 322 | A -> V | No |
| 322 | A -> | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |
| 726 | P -> L | Yes |
| 872 | V -> A | Yes |
| 907 | A -> T | Yes |
| 959 | E -> D | Yes |
| 1073 | D -> G | Yes |
| 1120 | P -> L | Yes |
| 1121 | C -> S | Yes |
| 1124 | L -> I | Yes |
| 1125 | D -> H | Yes |
| 1176 | S -> N | Yes |
| 1207 | A -> V | Yes |
| 1210 | R -> L | Yes |
| 1286 | A -> S | Yes |
| 1317 | I -> F | Yes |
| 1387 | Q -> H | Yes |
| 1411 | R -> C | Yes |

Variant protein HSCOC4_PEA_1_P15 (SEQ ID NO:344) is encoded by the following transcript(s): HSCOC4_PEA_1_T14 (SEQ ID NO:24), for which the sequence(s) is/are given at the end of the application. The coding portion of transcript HSCOC4_PEA_1_T14 (SEQ ID NO:24) is shown in bold; this coding portion starts at position 501 and ends at position 4745. The transcript also has the following SNPs as listed in Table 159 (given according to their position on the nucleotide sequence, with the alternative nucleic acid listed; the last column indicates whether the SNP is known or not; the presence of known SNPs in variant protein HSCOC4_PEA_1_P15 (SEQ ID NO:344) sequence provides support for the deduced sequence of this variant protein according to the present invention).

TABLE 159

| Nucleic acid SNPs | | |
|---|---|---|
| SNP position on nucleotide sequence | Alternative nucleic acid | Previously known SNP? |
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |

TABLE 159-continued

Nucleic acid SNPs

| SNP position on nucleotide sequence | Alternative nucleic acid | Previously known SNP? |
|---|---|---|
| 2435 | G -> A | Yes |
| 2540 | C -> T | No |
| 2677 | C -> T | Yes |
| 2975 | C -> T | Yes |
| 3115 | T -> C | Yes |
| 3146 | G -> T | Yes |
| 3219 | G -> A | Yes |
| 3377 | A -> C | Yes |
| 3456 | T -> C | Yes |
| 3611 | G -> T | Yes |
| 3718 | A -> G | Yes |
| 3785 | C -> A | Yes |
| 3859 | C -> T | Yes |
| 3862 | G -> C | Yes |
| 3870 | T -> A | Yes |
| 3873 | G -> C | Yes |
| 3875 | C -> T | Yes |
| 4027 | G -> A | Yes |
| 4034 | T -> C | Yes |
| 4115 | C -> G | Yes |
| 4120 | C -> T | Yes |
| 4129 | G -> T | Yes |
| 4130 | G -> C | Yes |
| 4226 | G -> A | Yes |
| 4232 | C -> G | Yes |
| 4235 | G -> A | Yes |
| 4356 | G -> T | Yes |
| 4449 | A -> T | Yes |
| 4661 | A -> C | Yes |
| 4731 | C -> T | Yes |
| 4872 | A -> G | Yes |
| 4905 | C -> T | Yes |
| 5061 | A -> G | No |
| 5153 | T -> C | Yes |
| 5287 | G -> | No |
| 5703 | C -> G | Yes |
| 5914 | G -> C | No |
| 5957 | G -> A | Yes |
| 5967 | A -> C | Yes |
| 6142 | A -> C | Yes |
| 6148 | G -> A | Yes |
| 6213 | A -> C | Yes |

Variant protein HSCOC4_PEA_1_P16 (SEQ ID NO:345) according to the present invention has an amino acid sequence as given at the end of the application; it is encoded by transcript(s) HSCOC4_PEA_1_T15 (SEQ ID NO:25). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P16 (SEQ ID NO:345) and CO4_HUMAN_V1 (SEQ ID NO:389):

1. An isolated chimeric polypeptide encoding for HSCOC4_PEA_1_P116 (SEQ ID NO:345), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSV SVFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYAAWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEYDELPAKDDPDA-PLQPVTPLQLFEGRRNRRRREAPK corresponding to amino acids 1-1457 of CO4_HUMAN_V1 (SEQ ID NO:389), which also corresponds to amino acids 1-1457 of HSCOC4_PEA_1_P16 (SEQ ID NO:345), and a second amino acid sequence being at least 70%, optionally at least 80%, preferably at least 85%, more preferably at least 90% and most preferably at least 95% homologous to a polypeptide having the sequence AERQGGAVWHGHR-GRHPPEWIPRPAC (SEQ ID NO: 549) corresponding to amino acids 1458-1483 of HSCOC4_PEA_1_P16 (SEQ ID NO:345), wherein said first amino acid sequence and second amino acid sequence are contiguous and in a sequential order.

2. An isolated polypeptide encoding for a tail of HSCOC4_PEA_1_P16 (SEQ ID NO:345), comprising a polypeptide being at least 70%, optionally at least about 80%, preferably at least about 85%, more preferably at least about 90% and most preferably at least about 95% homologous to the sequence AERQGGAVWHGHR-GRHPPEWIPRPAC (SEQ ID NO: 549) in HSCOC4_PEA_1_P16 (SEQ ID NO:345).

It should be noted that the known protein sequence (CO4_HUMAN) has one or more changes than the sequence given at the end of the application and named as being the amino acid sequence for CO4_HUMAN_V1 (SEQ ID NO:389). These changes were previously known to occur and are listed in the table below.

TABLE 160

Changes to CO4_HUMAN_V1 (SEQ ID NO: 389)

| SNP position(s) on amino acid sequence | Type of change |
|---|---|
| 1177 | Variant |
| 1202 | Variant |
| 1208 | Variant |
| 1211 | Variant |
| 1287 | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HSCOC4 PEA__1_P16 (SEQ ID NO:345) also has the following non-silent SNPs (Single Nucleotide Polymorphisms) as listed in Table 161, (given according to their position(s) on the amino acid sequence, with the alternative amino acid(s) listed; the last column indicates whether the SNP is known or not; the presence of known SNPs in variant protein HSCOC4_PEA__1_P16 (SEQ ID NO:345) sequence provides support for the deduced sequence of this variant protein according to the present invention).

TABLE 161

Amino acid mutations

| SNP position(s) on amino acid sequence | Alternative amino acid(s) | Previously known SNP? |
|---|---|---|
| 128 | Q -> | No |
| 141 | L -> V | Yes |
| 183 | G -> | No |
| 211 | G -> | No |
| 322 | A -> | No |
| 322 | A -> V | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |
| 726 | P -> L | Yes |
| 872 | V -> A | Yes |
| 907 | A -> T | Yes |
| 959 | E -> D | Yes |
| 1073 | D -> G | Yes |
| 1120 | P -> L | Yes |
| 1121 | C -> S | Yes |
| 1124 | L -> I | Yes |
| 1125 | D -> H | Yes |
| 1176 | S -> N | Yes |
| 1207 | A -> V | Yes |
| 1210 | R -> L | Yes |
| 1286 | A -> S | Yes |
| 1317 | I -> F | Yes |
| 1390 | K -> E | No |

Variant protein HSCOC4_PEA__1_P16 (SEQ ID NO:345) is encoded by the following transcript(s): HSCOC4_PEA__1_T15 (SEQ ID NO:25), for which the sequence(s) is/are given at the end of the application. The coding portion of transcript HSCOC4_PEA__1_T15 (SEQ ID NO:25) is shown in bold; this coding portion starts at position 501 and ends at position 4949. The transcript also has the following SNPs as listed in Table 162 (given according to their position on the nucleotide sequence, with the alternative nucleic acid listed; the last column indicates whether the SNP is known or not; the presence of known SNPs in variant protein HSCOC4_PEA__1_P16 (SEQ ID NO:345) sequence provides support for the deduced sequence of this variant protein according to the present invention).

TABLE 162

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |
| 2435 | G -> A | Yes |
| 2540 | C -> T | No |
| 2677 | C -> T | Yes |
| 2975 | C -> T | Yes |
| 3115 | T -> C | Yes |
| 3146 | G -> T | Yes |
| 3219 | G -> A | Yes |
| 3377 | A -> C | Yes |
| 3456 | T -> C | Yes |
| 3611 | G -> T | Yes |
| 3718 | A -> G | Yes |
| 3785 | C -> A | Yes |
| 3859 | C -> T | Yes |
| 3862 | G -> C | Yes |
| 3870 | T -> A | Yes |
| 3873 | G -> C | Yes |
| 3875 | C -> T | Yes |
| 4027 | G -> A | Yes |
| 4034 | T -> C | Yes |
| 4115 | C -> G | Yes |
| 4120 | C -> T | Yes |
| 4129 | G -> T | Yes |
| 4130 | G -> C | Yes |
| 4226 | G -> A | Yes |
| 4232 | C -> G | Yes |
| 4235 | G -> A | Yes |
| 4356 | G -> T | Yes |
| 4449 | A -> T | Yes |
| 4668 | A -> G | No |
| 4760 | T -> C | Yes |
| 5263 | C -> G | Yes |
| 5474 | G -> C | No |
| 5517 | G -> A | Yes |
| 5527 | A -> C | Yes |
| 5702 | A -> C | Yes |
| 5708 | G -> A | Yes |
| 5773 | A -> C | Yes |

Variant protein HSCOC4_PEA__1_P20 (SEQ ID NO:346) according to the present invention has an amino acid sequence as given at the end of the application; it is encoded by transcript(s) HSCOC4_PEA__1_T20 (SEQ ID NO:26). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P20 (SEQ ID NO:346) and CO4_HUMAN_V1(SEQ ID NO:389):

1. An isolated chimeric polypeptide encoding for HSCOC4_PEA_1_P20 (SEQ ID NO:346), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFS SRRGHLFLQTDQPIYNPGQRVRYRV-FALDQKMRPSTDTITVMV ENSHGL-RVRKKEVYMPSSIFQDDFVIPDIS-EPGTWKISARFSDGLESNSSTQFEVKKYVL PNFEVKITPGKPYILTVPGHLDEM-QLDIQARYIYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSV SVFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYAAWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQ corresponding to amino acids 1-1303 of CO4_HUMAN_V1 (SEQ ID NO:389), which also corresponds to amino acids 1-1303 of HSCOC4_PEA_1_P20 (SEQ ID NO:346), and a second amino acid sequence being at least 70%, optionally at least 80%, preferably at least 85%, more preferably at least 90% and most preferably at least 95% homologous to a polypeptide having the sequence VGAVPGLWRGWVVLRPRA-CLSPGSTSLGHGDCPGCPVCLLDCLPHH (SEQ ID NO: 550) corresponding to amino acids 1304-1349 of HSCOC4_PEA_1_P20 (SEQ ID NO:346), wherein said first amino acid sequence and second amino acid sequence are contiguous and in a sequential order.

2. An isolated polypeptide encoding for a tail of HSCOC4_PEA_1_P20 (SEQ ID NO:346), comprising a polypeptide being at least 70%, optionally at least about 80%, preferably at least about 85%, more preferably at least about 90% and most preferably at least about 95% homologous to the sequence VGAVPGLWRGWVVLRPRA-CLSPGSTSLGHGDCPGCPVCLLDCLPHH (SEQ ID NO: 550) in HSCOC4_PEA_1_P20 (SEQ ID NO:346).

It should be noted that the known protein sequence (CO4_HUMAN) has one or more changes than the sequence given at the end of the application and named as being the amino acid sequence for CO4_HUMAN_V1 (SEQ ID NO:389). These changes were previously known to occur and are listed in the table below.

TABLE 163

Changes to CO4_HUMAN_V1 (SEQ ID NO: 389)

| SNP position(s) on amino acid sequence | Type of change |
| --- | --- |
| 1177 | Variant |
| 1202 | Variant |
| 1208 | Variant |
| 1211 | Variant |
| 1287 | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA_1_P20 (SEQ ID NO:346) also has the following non-silent SNPs (Single Nucleotide Polymorphisms) as listed in Table 164 (given according to their position(s) on the amino acid sequence, with the alternative amino acid(s) listed; the last column indicates whether the SNP is known or not; the presence of known SNPs in variant protein HSCOC4_PEA_1_P20 (SEQ ID NO:346) sequence provides support for the deduced sequence of this variant protein according to the present invention).

TABLE 164

Amino acid mutations

| SNP position(s) on amino acid sequence | Alternative amino acid(s) | Previously known SNP? |
| --- | --- | --- |
| 128 | Q -> | No |
| 141 | L -> V | Yes |
| 183 | G -> | No |
| 211 | G -> | No |
| 322 | A -> | No |
| 322 | A -> V | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |

TABLE 164-continued

Amino acid mutations

| SNP position(s) on amino acid sequence | Alternative amino acid(s) | Previously known SNP? |
|---|---|---|
| 726 | P -> L | Yes |
| 872 | V -> A | Yes |
| 907 | A -> T | Yes |
| 959 | E -> D | Yes |
| 1073 | D -> G | Yes |
| 1120 | P -> L | Yes |
| 1121 | C -> S | Yes |
| 1124 | L -> I | Yes |
| 1125 | D -> H | Yes |
| 1176 | S -> N | Yes |
| 1207 | A -> V | Yes |
| 1210 | R -> L | Yes |
| 1286 | A -> S | Yes |
| 1312 | R -> G | Yes |
| 1344 | D -> V | Yes |

Variant protein HSCOC4_PEA_1_P20 (SEQ ID NO:346) is encoded by the following transcript(s): HSCOC4_PEA_1_T20 (SEQ ID NO:26), for which the sequence(s) is/are given at the end of the application. The coding portion of transcript HSCOC4_PEA_1_T20 (SEQ ID NO:26) is shown in bold; this coding portion starts at position 501 and ends at position 4547. The transcript also has the following SNPs as listed in Table 165 (given according to their position on the nucleotide sequence, with the alternative nucleic acid listed; the last column indicates whether the SNP is known or not; the presence of known SNPs in variant protein HSCOC4_PEA_1_P20 (SEQ ID NO:346) sequence provides support for the deduced sequence of this variant protein according to the present invention).

TABLE 165

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |
| 2435 | G -> A | Yes |
| 2540 | C -> T | No |
| 2677 | C -> T | Yes |
| 2975 | C -> T | Yes |
| 3115 | T -> C | Yes |
| 3146 | G -> T | Yes |
| 3219 | G -> A | Yes |
| 3377 | A -> C | Yes |
| 3456 | T -> C | Yes |
| 3611 | G -> T | Yes |
| 3718 | A -> G | Yes |
| 3785 | C -> A | Yes |
| 3859 | C -> T | Yes |
| 3862 | G -> C | Yes |
| 3870 | T -> A | Yes |
| 3873 | G -> C | Yes |
| 3875 | C -> T | Yes |
| 4027 | G -> A | Yes |
| 4034 | T -> C | Yes |
| 4115 | C -> G | Yes |
| 4120 | C -> T | Yes |
| 4129 | G -> T | Yes |
| 4130 | G -> C | Yes |
| 4226 | G -> A | Yes |
| 4232 | C -> G | Yes |
| 4235 | G -> A | Yes |
| 4356 | G -> T | Yes |
| 4434 | C -> G | Yes |
| 4531 | A -> T | Yes |
| 4743 | A -> C | Yes |
| 4813 | C -> T | Yes |
| 4954 | A -> G | Yes |
| 4987 | C -> T | Yes |
| 5143 | A -> G | No |
| 5235 | T -> C | Yes |
| 5369 | G -> | No |
| 5785 | C -> G | Yes |
| 5996 | G -> C | No |
| 6039 | G -> A | Yes |
| 6049 | A -> C | Yes |
| 6224 | A -> C | Yes |
| 6230 | G -> A | Yes |
| 6295 | A -> C | Yes |

Variant protein HSCOC4_PEA_1_P9 (SEQ ID NO:347) according to the present invention has an amino acid sequence as given at the end of the application; it is encoded by transcript(s) HSCOC4_PEA_1_T21 (SEQ ID NO:27). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P9 (SEQ ID NO:347) and CO4_HUMAN_V1 (SEQ ID NO:389):

1. An isolated chimeric polypeptide encoding for HSCOC4_PEA_1_P9 (SEQ ID NO:347), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSV SVFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYAAWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRREAPKVVEEQESRV HYTVCIWRNGKVGLSGMAIADVTLLSGF-HALRADLEKLTSLSDRYVSHFETEGPHVLL YFDSV corresponding to amino acids 1-1529 of CO4_HUMAN_V1 (SEQ ID NO:389), which also corresponds to amino acids 1-1529 of HSCOC4_PEA__1_P9 (SEQ ID NO:347) and a second amino acid sequence being at least 70%, optionally at least 80%, preferably at least 85%, more preferably at least 90% and most preferably at least 95% homologous to a polypeptide having the sequence SGER (SEQ ID NO: 551) corresponding to amino acids 1530-1533 of HSCOC4_PEA__1_P9 (SEQ ID NO:347), wherein said first amino acid sequence and second amino acid sequence are contiguous and in a sequential order.

2. An isolated polypeptide encoding for a tail of HSCOC4_PEA__1_P9 (SEQ ID NO:347), comprising a polypeptide being at least 70%, optionally at least about 80%, preferably at least about 85%, more preferably at least about 90% and most preferably at least about 95% homologous to the sequence SGER (SEQ ID NO: 551) in HSCOC4_PEA__1_P9 (SEQ ID NO:347).

It should be noted that the known protein sequence (CO4_HUMAN) has one or more changes than the sequence given at the end of the application and named as being the amino acid sequence for CO4_HUMAN_V1 (SEQ ID NO:389). These changes were previously known to occur and are listed in the table below.

TABLE 166

Changes to CO4_HUMAN_V1 (SEQ ID NO:389)

| SNP position(s) on amino acid sequence | Type of change |
|---|---|
| 1177 | Variant |
| 1202 | Variant |
| 1208 | Variant |
| 1211 | Variant |
| 1287 | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA__1_P9 (SEQ ID NO:347) also has the following non-silent SNPs (Single Nucleotide Polymorphisms) as listed in Table 167, (given according to their position(s) on the amino acid sequence, with the alternative amino acid(s) listed; the last column indicates whether the SNP is known or not; the presence of known SNPs in variant protein HSCOC4_PEA__1_P9 (SEQ ID NO:347) sequence provides support for the deduced sequence of this variant protein according to the present invention).

TABLE 167

Amino acid mutations

| SNP position(s) on amino acid sequence | Alternative amino acid(s) | Previously known SNP? |
|---|---|---|
| 128 | Q -> | No |
| 141 | L -> V | Yes |
| 183 | G -> | No |
| 211 | G -> | No |
| 322 | A -> V | No |
| 322 | A -> | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |
| 726 | P -> L | Yes |
| 872 | V -> A | Yes |
| 907 | A -> T | Yes |
| 959 | E -> D | Yes |
| 1073 | D -> G | Yes |
| 1120 | P -> L | Yes |
| 1121 | C -> S | Yes |
| 1124 | L -> I | Yes |
| 1125 | D -> H | Yes |
| 1176 | S -> N | Yes |
| 1207 | A -> V | Yes |
| 1210 | R -> L | Yes |
| 1286 | A -> S | Yes |
| 1317 | I -> F | Yes |
| 1390 | K -> E | No |
| 1465 | R -> | No |

Variant protein HSCOC4_PEA__1_P9 (SEQ ID NO:347) is encoded by the following transcript(s): HSCOC4_PEA__1_T21 (SEQ ID NO:27), for which the sequence(s) is/are given at the end of the application. The coding portion of transcript HSCOC4_PEA__1_T21 (SEQ ID NO:27) is shown in bold; this coding portion starts at position 501 and ends at position 5099. The transcript also has the following SNPs as listed in Table 168 (given according to their position on the nucleotide sequence, with the alternative nucleic acid listed; the last column indicates whether the SNP is known or not; the presence of known SNPs in variant protein HSCOC4_PEA_1_P9 (SEQ ID NO:347) sequence provides support for the deduced sequence of this variant protein according to the present invention).

TABLE 168

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |
| 2435 | G -> A | Yes |
| 2540 | C -> T | No |
| 2677 | C -> T | Yes |
| 2975 | C -> T | Yes |
| 3115 | T -> C | Yes |
| 3146 | G -> T | Yes |
| 3219 | G -> A | Yes |
| 3377 | A -> C | Yes |
| 3456 | T -> C | Yes |
| 3611 | G -> T | Yes |
| 3718 | A -> G | Yes |
| 3785 | C -> A | Yes |
| 3859 | C -> T | Yes |
| 3862 | G -> C | Yes |
| 3870 | T -> A | Yes |
| 3873 | G -> C | Yes |
| 3875 | C -> T | Yes |
| 4027 | G -> A | Yes |
| 4034 | T -> C | Yes |
| 4115 | C -> G | Yes |
| 4120 | C -> T | Yes |
| 4129 | G -> T | Yes |
| 4130 | G -> C | Yes |
| 4226 | G -> A | Yes |
| 4232 | C -> G | Yes |
| 4235 | G -> A | Yes |
| 4356 | G -> T | Yes |
| 4449 | A -> T | Yes |
| 4668 | A -> G | No |
| 4760 | T -> C | Yes |
| 4894 | G -> | No |
| 5561 | G -> A | Yes |
| 6026 | T -> G | Yes |
| 6348 | G -> C | Yes |
| 6966 | C -> G | Yes |
| 7177 | G -> C | No |
| 7220 | G -> A | Yes |
| 7230 | A -> C | Yes |
| 7405 | A -> C | Yes |
| 7411 | G -> A | Yes |
| 7476 | A -> C | Yes |

Variant protein HSCOC4_PEA_1_P22 (SEQ ID NO:348) according to the present invention has an amino acid sequence as given at the end of the application; it is encoded by transcript(s) HSCOC4_PEA_1_T25 (SEQ ID NO:28). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P22 (SEQ ID NO:348) and CO4_HUMAN_V1 (SEQ ID NO:389):

1. An isolated chimeric polypeptide encoding for HSCOC4_PEA_1_P22 (SEQ ID NO:348), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYAAWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRREAPKVVEEQESRV HYTVCIWRNGKVGLSGMAIADVTLLSGF-HALRADLEKLTSLSDRYVSHFETEGPHVLL YFDS-VPTSRECVGFEAVQEVPVGLVQPASAT- LYDYYNPERRCSVFYGAPSKSRLLATLC SAEVCQCAEGKCPRQRRALERGLQD-EDGYRMKFACYYPRVEYGFQVKVLREDSRAAF RLFETKITQVLHF corresponding to amino acids 1-1653 of CO4_HUMAN_V1 (SEQ ID NO:389), which also corresponds to amino acids 1-1653 of HSCOC4_PEA_1_P22 (SEQ ID NO:348), and a second amino acid sequence being at least 70%, optionally at least 80%, preferably at least 85%, more preferably at least 90% and most preferably at least 95% homologous to a polypeptide having the sequence SMKQTGEAGRAGGRQGG (SEQ ID NO: 552) corresponding to amino acids 1654-1670 of HSCOC4_PEA_1_P22 (SEQ ID NO:348), wherein said first amino acid sequence and second amino acid sequence are contiguous and in a sequential order.

2. An isolated polypeptide encoding for a tail of HSCOC4_PEA_1_P22 (SEQ ID NO:348), comprising a polypeptide being at least 70%, optionally at least about 80%, preferably at least about 85%, more preferably at least about 90% and most preferably at least about 95% homologous to the sequence SMKQTGEAGRAGGRQGG (SEQ ID NO: 552) in HSCOC4_PEA_1_P22 (SEQ ID NO:348).

It should be noted that the known protein sequence (CO4_HUMAN) has one or more changes than the sequence given at the end of the application and named as being the amino acid sequence for CO4_HUMAN_V1 (SEQ ID NO:389). These changes were previously known to occur and are listed in the table below.

TABLE 169

Changes to CO4_HUMAN_V1 (SEQ ID NO:389)

| SNP position(s) on amino acid sequence | Type of change |
|---|---|
| 1177 | Variant |
| 1202 | Variant |
| 1208 | Variant |
| 1211 | Variant |
| 1287 | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA_1_P22 (SEQ ID NO:348) also has the following non-silent SNPs (Single Nucleotide Polymorphisms) as listed in Table 170 (given according to their position(s) on the amino acid sequence, with the alternative amino acid(s) listed; the last column indicates whether the SNP is known or not; the presence of known SNPs in variant protein HSCOC4_PEA_1_P22 (SEQ ID NO:348) sequence provides support for the deduced sequence of this variant protein according to the present invention).

TABLE 170

Amino acid mutations

| SNP position(s) on amino acid sequence | Alternative amino acid(s) | Previously known SNP? |
|---|---|---|
| 128 | Q -> | No |
| 141 | L -> V | Yes |
| 183 | G -> | No |
| 211 | G -> | No |
| 322 | A -> | No |
| 322 | A -> V | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |
| 726 | P -> L | Yes |
| 872 | V -> A | Yes |
| 907 | A -> T | Yes |
| 959 | E -> D | Yes |
| 1073 | D -> G | Yes |
| 1120 | P -> L | Yes |
| 1121 | C -> S | Yes |
| 1124 | L -> I | Yes |
| 1125 | D -> H | Yes |
| 1176 | S -> N | Yes |
| 1207 | A -> V | Yes |
| 1210 | R -> L | Yes |
| 1286 | A -> S | Yes |
| 1317 | I -> F | Yes |
| 1390 | K -> E | No |
| 1465 | R -> | No |
| 1604 | R -> G | Yes |

Variant protein HSCOC4_PEA_1_P22 (SEQ ID NO:348) is encoded by the following transcript(s): HSCOC4_PEA_1_T25 (SEQ ID NO:28), for which the sequence(s) is/are given at the end of the application. The coding portion of transcript HSCOC4_PEA_1_T25 (SEQ ID NO:28) is shown in bold; this coding portion starts at position 501 and ends at position 5510. The transcript also has the following SNPs as listed in Table 171 (given according to their position on the nucleotide sequence, with the alternative nucleic acid listed; the last column indicates whether the SNP is known or not; the presence of known SNPs in variant protein HSCOC4_PEA_1_P22 (SEQ ID NO:348) sequence provides support for the deduced sequence of this variant protein according to the present invention).

TABLE 171

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |

TABLE 171-continued

Nucleic acid SNPs

| SNP position on nucleotide sequence | Alternative nucleic acid | Previously known SNP? |
| --- | --- | --- |
| 2349 | A -> G | Yes |
| 2435 | G -> A | Yes |
| 2540 | C -> T | No |
| 2677 | C -> T | Yes |
| 2975 | C -> T | Yes |
| 3115 | T -> C | Yes |
| 3146 | G -> T | Yes |
| 3219 | G -> A | Yes |
| 3377 | A -> C | Yes |
| 3456 | T -> C | Yes |
| 3611 | G -> T | Yes |
| 3718 | A -> G | Yes |
| 3785 | C -> A | Yes |
| 3859 | C -> T | Yes |
| 3862 | G -> C | Yes |
| 3870 | T -> A | Yes |
| 3873 | G -> C | Yes |
| 3875 | C -> T | Yes |
| 4027 | G -> A | Yes |
| 4034 | T -> C | Yes |
| 4115 | C -> G | Yes |
| 4120 | C -> T | Yes |
| 4129 | G -> T | Yes |
| 4130 | G -> C | Yes |
| 4226 | G -> A | Yes |
| 4232 | C -> G | Yes |
| 4235 | G -> A | Yes |
| 4356 | G -> T | Yes |
| 4449 | A -> T | Yes |
| 4668 | A -> G | No |
| 4760 | T -> C | Yes |
| 4894 | G -> | No |
| 5310 | C -> G | Yes |
| 5783 | G -> C | No |
| 5826 | G -> A | Yes |
| 5836 | A -> C | Yes |
| 5974 | C -> T | Yes |
| 5981 | C -> T | Yes |
| 6154 | A -> C | Yes |
| 6160 | G -> A | Yes |
| 6225 | A -> C | Yes |
| 6283 | C -> T | Yes |
| 6548 | C -> T | Yes |
| 6567 | C -> T | Yes |
| 7300 | C -> A | Yes |
| 7520 | C -> T | Yes |
| 7685 | A -> C | Yes |

Variant protein HSCOC4_PEA_1_P23 (SEQ ID NO:349) according to the present invention has an amino acid sequence as given at the end of the application; it is encoded by transcript(s) HSCOC4_PEA_1_T28 (SEQ ID NO:29). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P23 (SEQ ID NO:349) and CO4_HUMAN_V1 (SEQ ID NO:389):

1. An isolated chimeric polypeptide encoding for HSCOC4_PEA_1_P23 (SEQ ID NO:349), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSV SVFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYAAWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRREAPKVVEEQESRV HYTVCIWRNGKVGLSGMAIADVTLLSGF-HALRADLEKLTSLSDRYVSHFETEGPHVLL YFDS-VPTSRECVGFEAVQEVPVGLVQPASAT-LYDYYNPERRCSVFYGAPSKSRLLATLC SAEVCQCAEGKCPRQRRALERGLQD-EDGYRMKFACYYPRVEYG corresponding to amino acids 1-1626 of CO4_HUMAN_V1 (SEQ ID NO:389), which also corresponds to amino acids 1-1626 of HSCOC4_PEA_1_P23 (SEQ ID NO:349), and a second amino acid sequence being at least 70%, optionally at least 80%, preferably at least 85%, more preferably at least 90% and most preferably at least 95% homologous to a polypeptide having the sequence QSSHRGPGLTLPRGPAVLVS-LGVACSSYRSCTQPVCSDTN-FLPSQPQSNSPFPLLLTPS (SEQ ID NO: 553) corresponding to amino acids 1627-1685 of HSCOC4_PEA_1_P23 (SEQ ID NO:349), wherein said first amino acid sequence and second amino acid sequence are contiguous and in a sequential order.

2. An isolated polypeptide encoding for a tail of HSCOC4_PEA_1_P23 (SEQ ID NO:349), comprising a polypeptide being at least 70%, optionally at least about 80%, preferably at least about 85%, more preferably at least about 90% and most preferably at least about 95% homologous to the sequence QSSHRGPGLTLPRGPAVLVSLG-VACSSYRSCTQPVCSDTNFLPSQPQSNSPFPLLLTPS in (SEQ ID NO: 553) HSCOC4_PEA_1_P23 (SEQ ID NO:349).

It should be noted that the known protein sequence (CO4_HUMAN) has one or more changes than the sequence given at the end of the application and named as being the amino acid sequence for CO4_HUMAN_V1 (SEQ ID NO:389). These changes were previously known to occur and are listed in the table below.

TABLE 172

Changes to CO4_HUMAN_V1 (SEQ ID NO:389)

| SNP position(s) on amino acid sequence | Type of change |
|---|---|
| 1177 | Variant |
| 1202 | Variant |
| 1208 | Variant |
| 1211 | Variant |
| 1287 | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HSCOC4_PEA_1_P23 (SEQ ID NO:349) also has the following non-silent SNPs (Single Nucleotide Polymorphisms) as listed in Table 173, (given according to their position(s) on the amino acid sequence, with the alternative amino acid(s) listed; the last column indicates whether the SNP is known or not; the presence of known SNPs in variant protein HSCOC4_PEA_1_P23 (SEQ ID NO:349) sequence provides support for the deduced sequence of this variant protein according to the present invention).

TABLE 173

Amino acid mutations

| SNP position(s) on amino acid sequence | Alternative amino acid(s) | Previously known SNP? |
|---|---|---|
| 128 | Q -> | No |
| 141 | L -> V | Yes |
| 183 | G -> | No |
| 211 | G -> | No |
| 322 | A -> V | No |
| 322 | A -> | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |
| 726 | P -> L | Yes |
| 872 | V -> A | Yes |
| 907 | A -> T | Yes |
| 959 | E -> D | Yes |
| 1073 | D -> G | Yes |
| 1120 | P -> L | Yes |
| 1121 | C -> S | Yes |
| 1124 | L -> I | Yes |

TABLE 173-continued

Amino acid mutations

| SNP position(s) on amino acid sequence | Alternative amino acid(s) | Previously known SNP? |
|---|---|---|
| 1125 | D -> H | Yes |
| 1176 | S -> N | Yes |
| 1207 | A -> V | Yes |
| 1210 | R -> L | Yes |
| 1286 | A -> S | Yes |
| 1317 | I -> F | Yes |
| 1390 | K -> E | No |
| 1465 | R -> | No |
| 1604 | R -> G | Yes |
| 1634 | G -> | Yes |

Variant protein HSCOC4_PEA_1_P23 (SEQ ID NO:349) is encoded by the following transcript(s): HSCOC4_PEA_1_T28 (SEQ ID NO:29), for which the sequence(s) is/are given at the end of the application. The coding portion of transcript HSCOC4_PEA_1_T28 (SEQ ID NO:29) is shown in bold; this coding portion starts at position 501 and ends at position 5555. The transcript also has the following SNPs as listed in Table 174 (given according to their position on the nucleotide sequence, with the alternative nucleic acid listed; the last column indicates whether the SNP is known or not; the presence of known SNPs in variant protein HSCOC4_PEA_1_P23 (SEQ ID NO:349) sequence provides support for the deduced sequence of this variant protein according to the present invention).

TABLE 174

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |
| 2435 | G -> A | Yes |
| 2540 | C -> T | No |
| 2677 | C -> T | Yes |
| 2975 | C -> T | Yes |
| 3115 | T -> C | Yes |
| 3146 | G -> T | Yes |
| 3219 | G -> A | Yes |
| 3377 | A -> C | Yes |
| 3456 | T -> C | Yes |
| 3611 | G -> T | Yes |
| 3718 | A -> G | Yes |
| 3785 | C -> A | Yes |
| 3859 | C -> T | Yes |
| 3862 | G -> C | Yes |
| 3870 | T -> A | Yes |
| 3873 | G -> C | Yes |
| 3875 | C -> T | Yes |
| 4027 | G -> A | Yes |

TABLE 174-continued

Nucleic acid SNPs

| SNP position on nucleotide sequence | Alternative nucleic acid | Previously known SNP? |
|---|---|---|
| 4034 | T -> C | Yes |
| 4115 | C -> G | Yes |
| 4120 | C -> T | Yes |
| 4129 | G -> T | Yes |
| 4130 | G -> C | Yes |
| 4226 | G -> A | Yes |
| 4232 | C -> G | Yes |
| 4235 | G -> A | Yes |
| 4356 | G -> T | Yes |
| 4449 | A -> T | Yes |
| 4668 | A -> G | No |
| 4760 | T -> C | Yes |
| 4894 | G -> | No |
| 5310 | C -> G | Yes |
| 5402 | C -> | Yes |
| 5426 | T -> C | Yes |
| 5965 | G -> C | No |
| 6008 | G -> A | Yes |
| 6018 | A -> C | Yes |
| 6156 | C -> T | Yes |
| 6163 | C -> T | Yes |
| 6336 | A -> C | Yes |
| 6342 | G -> A | Yes |
| 6407 | A -> C | Yes |
| 6465 | C -> T | Yes |
| 6730 | C -> T | Yes |
| 6749 | C -> T | Yes |
| 7482 | C -> A | Yes |
| 7702 | C -> T | Yes |
| 7867 | A -> C | Yes |

Variant protein HSCOC4_PEA_1_P24 (SEQ ID NO:350) according to the present invention has an amino acid sequence as given at the end of the application; it is encoded by transcript(s) HSCOC4_PEA_1_T30 (SEQ ID NO:30). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P24 (SEQ ID NO:350) and CO4_HUMAN_V1 (SEQ ID NO:389):

1. An isolated chimeric polypeptide encoding for HSCOC4_PEA_1_P24 (SEQ ID NO:350), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGGQIVFMNREPKRTLTSV SVFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYAAWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRREAPKVVEEQESRV HYTVCIWRNGKVGLSGMAIADVTLLSGF-HALRADLEKLTSLSDRYVSHFETEGPHVLL YFDS corresponding to amino acids 1-1528 of CO4_HUMAN_V1 (SEQ ID NO:389), which also corresponds to amino acids 1-1528 of HSCOC4_PEA_1_P24 (SEQ ID NO:350), and a second amino acid sequence being at least 70%, optionally at least 80%, preferably at least 85%, more preferably at least 90% and most preferably at least 95% homologous to a polypeptide having the sequence SADVLCFT-GHQVRADSWPPCVLLKSASVLRGSALAS-VAPWSGVCRTRMATG (SEQ ID NO: 554) corresponding to amino acids 1529-1579 of HSCOC4_PEA_1_P24 (SEQ ID NO:350), wherein said first amino acid sequence and second amino acid sequence are contiguous and in a sequential order.

2. An isolated polypeptide encoding for a tail of HSCOC4_PEA_1_P24 (SEQ ID NO:350), comprising a polypeptide being at least 70%, optionally at least about 80%, preferably at least about 85%, more preferably at least about 90% and most preferably at least about 95% homologous to the sequence SADVLCFTGHQVRADSWPPCV-LLKSASVLRGSALASVAPWSGVCRTRMATG (SEQ ID NO: 554) in HSCOC4_PEA_1_P24 (SEQ ID NO:350).

It should be noted that the known protein sequence (CO4_HUMAN) has one or more changes than the sequence given at the end of the application and named as being the amino acid sequence for CO4_HUMAN_V1 (SEQ ID NO:389). These changes were previously known to occur and are listed in the table below.

TABLE 175

Changes to CO4_HUMAN_V1 (SEQ ID NO:389)

| SNP position(s) on amino acid sequence | Type of change |
|---|---|
| 1177 | Variant |
| 1202 | Variant |
| 1208 | Variant |
| 1211 | Variant |
| 1287 | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA_1_P24 (SEQ ID NO:350) also has the following non-silent SNPs (Single Nucleotide Polymorphisms) as listed in Table 176, (given according to their position(s) on the amino acid sequence, with the alternative amino acid(s) listed; the last column indicates whether the SNP is known or not; the presence of known SNPs in variant protein HSCOC4_PEA_1_P24 (SEQ ID NO:350) sequence provides support for the deduced sequence of this variant protein according to the present invention).

TABLE 176

Amino acid mutations

| SNP position(s) on amino acid sequence | Alternative amino acid(s) | Previously known SNP? |
|---|---|---|
| 128 | Q -> | No |
| 141 | L -> V | Yes |
| 183 | G -> | No |
| 211 | G -> | No |
| 322 | A -> | No |
| 322 | A -> V | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |
| 726 | P -> L | Yes |
| 872 | V -> A | Yes |
| 907 | A -> T | Yes |
| 959 | E -> D | Yes |
| 1073 | D -> G | Yes |
| 1120 | P -> L | Yes |
| 1121 | C -> S | Yes |
| 1124 | L -> I | Yes |
| 1125 | D -> H | Yes |
| 1176 | S -> N | Yes |
| 1207 | A -> V | Yes |
| 1210 | R -> L | Yes |
| 1286 | A -> S | Yes |
| 1317 | I -> F | Yes |
| 1390 | K -> E | No |
| 1465 | R -> | No |
| 1569 | S -> R | Yes |

Variant protein HSCOC4_PEA_1_P24 (SEQ ID NO:350) is encoded by the following transcript(s): HSCOC4_PEA_1_T30 (SEQ ID NO:30), for which the sequence(s) is/are given at the end of the application. The coding portion of transcript HSCOC4_PEA_1_T30 (SEQ ID NO:30) is shown in bold; this coding portion starts at position 501 and ends at position 5237. The transcript also has the following SNPs as listed in Table 177 (given according to their position on the nucleotide sequence, with the alternative nucleic acid listed; the last column indicates whether the SNP is known or not; the presence of known SNPs in variant protein HSCOC4_PEA_1_P24 (SEQ ID NO:350) sequence provides support for the deduced sequence of this variant protein according to the present invention).

TABLE 177

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |
| 2435 | G -> A | Yes |
| 2540 | C -> T | No |
| 2677 | C -> T | Yes |
| 2975 | C -> T | Yes |
| 3115 | T -> C | Yes |
| 3146 | G -> T | Yes |
| 3219 | G -> A | Yes |
| 3377 | A -> C | Yes |
| 3456 | T -> C | Yes |
| 3611 | G -> T | Yes |
| 3718 | A -> G | Yes |
| 3785 | C -> A | Yes |
| 3859 | C -> T | Yes |
| 3862 | G -> C | Yes |
| 3870 | T -> A | Yes |
| 3873 | G -> C | Yes |
| 3875 | C -> T | Yes |
| 4027 | G -> A | Yes |
| 4034 | T -> C | Yes |
| 4115 | C -> G | Yes |
| 4120 | C -> T | Yes |
| 4129 | G -> T | Yes |
| 4130 | G -> C | Yes |
| 4226 | G -> A | Yes |
| 4232 | C -> G | Yes |
| 4235 | G -> A | Yes |
| 4356 | G -> T | Yes |
| 4449 | A -> T | Yes |
| 4668 | A -> G | No |
| 4760 | T -> C | Yes |
| 4894 | G -> | No |
| 5207 | C -> G | Yes |
| 5418 | G -> C | No |
| 5461 | G -> A | Yes |
| 5471 | A -> C | Yes |
| 5646 | A -> C | Yes |
| 5652 | G -> A | Yes |
| 5717 | A -> C | Yes |

Variant protein HSCOC4_PEA_1_P25 (SEQ ID NO:351) according to the present invention has an amino acid sequence as given at the end of the application; it is encoded by transcript(s) HSCOC4_PEA_1_T31 (SEQ ID NO:31). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P25 (SEQ ID NO:351) and CO4_HUMAN_V1 (SEQ ID NO:389):

1. An isolated chimeric polypeptide encoding for HSCOC4_PEA_1_P25 (SEQ ID NO:351), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLRTTNIQGINLLFSSRRGHLFLQT-DQPIYNPGQRVRYRVFALDQKMRPSTDTITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYAAWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRREAPKVVEEQESRV HYTVCIWRNGKVGLSGMAIADVTLLSGF-HALRADLEKLTSLSDRYVSHFETEGPHVLL YFDS-VPTSRECVGFEAVQEVPVGLVQPASAT-LYDYYNPERRCSVFYGAPSKSRLLATLC SAEVCQCAEG corresponding to amino acids 1-1593 of CO4_HUMAN_V1 (SEQ ID NO:389), which also corresponds to amino acids 1-1593 of HSCOC4_PEA_1_P25 (SEQ ID NO:351), and a second amino acid sequence being at least 70%, optionally at least 80%, preferably at least 85%, more preferably at least 90% and most preferably at least 95% homologous to a polypeptide having the sequence ETEGLGRGSGGGMAGAPPTLSDGFPN-FREVPSPASRPGAGSAGRGWLQDEVCLLLPPC GVR-LPG (SEQ ID NO: 555) corresponding to amino acids 1594-1657 of HSCOC4_PEA_1_P25 (SEQ ID NO:351), wherein said first amino acid sequence and second amino acid sequence are contiguous and in a sequential order.

2. An isolated polypeptide encoding for a tail of HSCOC4_PEA_1_P25 (SEQ ID NO:351), comprising a polypeptide being at least 70%, optionally at least about 80%, preferably at least about 85%, more preferably at least about 90% and most preferably at least about 95% homologous to the sequence ETEGLGRGSGGGMAGAPPTLS-DGFPNFREVPSPASRPGAGSAGRG-WLQDEVCLLLPPC GVRLPG (SEQ ID NO: 555) in HSCOC4_PEA_1_P25 (SEQ ID NO:351).

It should be noted that the known protein sequence (CO4_HUMAN) has one or more changes than the sequence given at the end of the application and named as being the amino acid sequence for CO4_HUMAN_V1 (SEQ ID NO:389). These changes were previously known to occur and are listed in the table below.

TABLE 178

| Changes to CO4_HUMAN_V1 (SEQ ID NO:389) | |
|---|---|
| SNP position(s) on amino acid sequence | Type of change |
| 1177 | Variant |
| 1202 | Variant |
| 1208 | Variant |
| 1211 | Variant |
| 1287 | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA_1_P25 (SEQ ID NO:351) also has the following non-silent SNPs (Single Nucleotide Polymorphisms) as listed in Table 179, (given according to their position(s) on the amino acid sequence, with the alternative amino acid(s) listed; the last column indicates whether the SNP is known or not; the presence of known SNPs in variant protein HSCOC4_PEA_1_P25 (SEQ ID NO:351) sequence provides support for the deduced sequence of this variant protein according to the present invention).

TABLE 179

Amino acid mutations

| SNP position(s) on amino acid sequence | Alternative amino acid(s) | Previously known SNP? |
|---|---|---|
| 128 | Q -> | No |
| 141 | L -> V | Yes |
| 183 | G -> | No |
| 211 | G -> | No |
| 322 | A -> | No |
| 322 | A -> V | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |
| 726 | P -> L | Yes |
| 872 | V -> A | Yes |
| 907 | A -> T | Yes |
| 959 | E -> D | Yes |
| 1073 | D -> G | Yes |
| 1120 | P -> L | Yes |
| 1121 | C -> S | Yes |
| 1124 | L -> I | Yes |
| 1125 | D -> H | Yes |
| 1176 | S -> N | Yes |
| 1207 | A -> V | Yes |
| 1210 | R -> L | Yes |
| 1286 | A -> S | Yes |
| 1317 | I -> F | Yes |
| 1390 | K -> E | No |
| 1465 | R -> | No |
| 1632 | A -> G | Yes |

Variant protein HSCOC4_PEA_1_P25 (SEQ ID NO:351) is encoded by the following transcript(s): HSCOC4_PEA_1_T31 (SEQ ID NO:31), for which the sequence(s) is/are given at the end of the application. The coding portion of transcript HSCOC4_PEA_1_T31 (SEQ ID NO:31) is shown in bold; this coding portion starts at position 501 and ends at position 5471. The transcript also has the following SNPs as listed in Table 180 (given according to their position on the nucleotide sequence, with the alternative nucleic acid listed; the last column indicates whether the SNP is known or not; the presence of known SNPs in variant protein HSCOC4_PEA_1_P25 (SEQ ID NO:351) sequence provides support for the deduced sequence of this variant protein according to the present invention).

TABLE 180

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |
| 2435 | G -> A | Yes |
| 2540 | C -> T | No |
| 2677 | C -> T | Yes |
| 2975 | C -> T | Yes |
| 3115 | T -> C | Yes |
| 3146 | G -> T | Yes |
| 3219 | G -> A | Yes |
| 3377 | A -> C | Yes |
| 3456 | T -> C | Yes |
| 3611 | G -> T | Yes |
| 3718 | A -> G | Yes |
| 3785 | C -> A | Yes |
| 3859 | C -> T | Yes |
| 3862 | G -> C | Yes |
| 3870 | T -> A | Yes |
| 3873 | G -> C | Yes |
| 3875 | C -> T | Yes |
| 4027 | G -> A | Yes |
| 4034 | T -> C | Yes |
| 4115 | C -> G | Yes |
| 4120 | C -> T | Yes |
| 4129 | G -> T | Yes |
| 4130 | G -> C | Yes |
| 4226 | G -> A | Yes |
| 4232 | C -> G | Yes |
| 4235 | G -> A | Yes |
| 4356 | G -> T | Yes |
| 4449 | A -> T | Yes |
| 4668 | A -> G | No |
| 4760 | T -> C | Yes |
| 4894 | G -> | No |
| 5395 | C -> G | Yes |
| 5606 | G -> C | No |
| 5649 | G -> A | Yes |
| 5659 | A -> C | Yes |
| 5834 | A -> C | Yes |
| 5840 | G -> A | Yes |
| 5905 | A -> C | Yes |

Variant protein HSCOC4_PEA_1_P26 (SEQ ID NO:352) according to the present invention has an amino acid sequence as given at the end of the application; it is encoded by transcript(s) HSCOC4_PEA_1_T32 (SEQ ID NO:32). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P26 (SEQ ID NO:352) and CO4_HUMAN_V1 (SEQ ID NO:389):

1. An isolated chimeric polypeptide encoding for HSCOC4_PEA_1_P26 (SEQ ID NO:352), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEKLNMGITDLQGLRLYVAAAIIESPGGEMEEAE LTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPD SRPPRVGDTLNLNLRAVGSGATFSHYYYMILSRGQIVFMNREPKRTLTSV SVFVDHHLA PSFYFVAFYYHGDHPVANSLRVDVQAGACEGKLELSVDGAKQYRNGESVKLHLETDS LALVALGALDTALYAAGSKSHKPLNMGKVFEAMNSYDLGCGPGGGDSALQVFQAAG LAFSDGDQWTLSRKRLSCPKEKTTRKKRNVNFQKAINEKLGQYASPTAKRCCQDGVTR LPMMRSCEQRAARVQQPDCREPFLSCCQFAESLRKKSRDKGQAGLQRALEILQEEDLID EDDIPVRSFFPENWLWRVETVDRFQILTLWLPDSLTTWEIHGLSLSKTKGLCVATPVQL RVFREFHLHLRLPMSVRRFEQLELRPVLYNYLDKNLTVSVHVSPVEGLCLAGGGGLAQ QVLVPAGSARPVAFSVVPTAAAAVSLKVVARGSFEFPVGDAVSKVLQIEKEGAIHREEL VYELNPLDHRGRTLEIPGNSDPNMIPDGDFNSYVRVTASDPLDTLGSEGALSPGGVASL LRLPRGCGEQTMIYLAPTLAASRYLDKTEQWSTLPPETKDHAVDLIQKGYMRIQQFRK ADGSYAAWLSRDSSTWLTAFVLKVLSLAQEQVGGSPEKLQETSNWLLSQQQADGSFQ DPCPVLDRSMQGGLVGNDETVALTAFVTIALHHGLAVFQDEGAEPLKQRVEASISKASS FLGEKASAGLLGAHAAAITAYALTLTKAPADLRGVAHNNLMAMAQETGDNLYWGSV TGSQSNAVSPTPAPRNPSDPMPQAPALWIETTAYALLHLLLHEGKAEMADQAAAWLTR QGSFQGGFRSTQDTVIALDALSAYWIASHTTEERGLNVTLSSTGRNGFKSHALQLNNRQ IRGLEEELQFSLGSKINVKVGGNSKGTLKVLRTYNVLDMKNTTCQDLQIEVTVKGHVE YTMEANEDYEDYEYDELPAKDDPDAPLQPVTPLQLFEGRRNRRRREAPKVVEEQESRV HYTVCIWRNGKVGLSGMAIADVTLLSGFHALRADLEKLTSLSDRYVSHFETEGPHVLL YFDSVPTSRECVGFEAVQEVPVGLVQPASATLYDYYNPERRCSVFYGAPSKSRLLATLC SAEVCQCAEG corresponding to amino acids 1-1593 of CO4_HUMAN_V1 (SEQ ID NO:389), which also corresponds to amino acids 1-1593 of HSCOC4_PEA_1_P26 (SEQ ID NO:352), and a second amino acid sequence being at least 70%, optionally at least 80%, preferably at least 85%, more preferably at least 90% and most preferably at least 95% homologous to a polypeptide having the sequence ETEGLGRGSGGGMAGAPPTLSDGFPNFREVPSPASRPGAGSAGRGWLQDEVCLLLPPC GVRSVFPPRPWPDPPSGTGCFGLSGCSLLLLQVMHAACLL (SEQ ID NO: 556) corresponding to amino acids 1594-1691 of HSCOC4_PEA_1_P26 (SEQ ID NO:352) wherein said first amino acid sequence and second amino acid sequence are contiguous and in a sequential order.

2. An isolated polypeptide encoding for a tail of HSCOC4_PEA_1_P26 (SEQ ID NO:352), comprising a polypeptide being at least 70%, optionally at least about 80%, preferably at least about 85%, more preferably at least about 90% and most preferably at least about 95% homologous to the sequence ETEGLGRGSGGGMAGAPPTLSDGFPNFREVPSPASRPGAGSAGRGWLQDEVCLLLPPC GVRSVFPPRPWPDPPSGTGCFGLSGCSLLLLQVMHAACLL (SEQ ID NO: 556) in HSCOC4_PEA_1_P26 (SEQ ID NO:352).

It should be noted that the known protein sequence (CO4_HUMAN) has one or more changes than the sequence given at the end of the application and named as being the amino acid sequence for CO4_HUMAN_V1 (SEQ ID NO:389). These changes were previously known to occur and are listed in the table below.

TABLE 181

| Changes to CO4_HUMAN_V1 (SEQ ID NO:389) | |
|---|---|
| SNP position(s) on amino acid sequence | Type of change |
| 1177 | Variant |
| 1202 | Variant |
| 1208 | Variant |
| 1211 | Variant |
| 1287 | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA_1_P26 (SEQ ID NO:352) also has the following non-silent SNPs (Single Nucleotide Polymorphisms) as listed in Table 182, (given according to their position(s) on the amino acid sequence, with the alternative amino acid(s) listed; the last column indicates whether the SNP is known or not; the presence of known SNPs in variant protein HSCOC4_PEA_1_P26 (SEQ ID NO:352) sequence provides support for the deduced sequence of this variant protein according to the present invention).

TABLE 182

| Amino acid mutations | | |
|---|---|---|
| SNP position(s) on amino acid sequence | Alternative amino acid(s) | Previously known SNP? |
| 128 | Q -> | No |
| 141 | L -> V | Yes |
| 183 | G -> | No |
| 211 | G -> | No |
| 322 | A -> | No |
| 322 | A -> V | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |
| 726 | P -> L | Yes |
| 872 | V -> A | Yes |
| 907 | A -> T | Yes |
| 959 | E -> D | Yes |
| 1073 | D -> G | Yes |
| 1120 | P -> L | Yes |
| 1121 | C -> S | Yes |
| 1124 | L -> I | Yes |
| 1125 | D -> H | Yes |
| 1176 | S -> N | Yes |
| 1207 | A -> V | Yes |

TABLE 182-continued

Amino acid mutations

| SNP position(s) on amino acid sequence | Alternative amino acid(s) | Previously known SNP? |
|---|---|---|
| 1210 | R -> L | Yes |
| 1286 | A -> S | Yes |
| 1317 | I -> F | Yes |
| 1390 | K -> E | No |
| 1465 | R -> | No |
| 1632 | A -> G | Yes |
| 1663 | P -> | Yes |
| 1671 | C -> R | Yes |

Variant protein HSCOC4_PEA_1_P26 (SEQ ID NO:352) is encoded by the following transcript(s): HSCOC4_PEA_1_T32 (SEQ ID NO:32), for which the sequence(s) is/are given at the end of the application. The coding portion of transcript HSCOC4_PEA_1_T32 (SEQ ID NO:32) is shown in bold; this coding portion starts at position 501 and ends at position 5573. The transcript also has the following SNPs as listed in Table 183 (given according to their position on the nucleotide sequence, with the alternative nucleic acid listed; the last column indicates whether the SNP is known or not; the presence of known SNPs in variant protein HSCOC4_PEA_1_P26 (SEQ ID NO:352) sequence provides support for the deduced sequence of this variant protein according to the present invention).

TABLE 183

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |
| 2435 | G -> A | Yes |
| 2540 | C -> T | No |
| 2677 | C -> T | Yes |
| 2975 | C -> T | Yes |
| 3115 | T -> C | Yes |
| 3146 | G -> T | Yes |
| 3219 | G -> A | Yes |
| 3377 | A -> C | Yes |
| 3456 | T -> C | Yes |
| 3611 | G -> T | Yes |
| 3718 | A -> G | Yes |
| 3785 | C -> A | Yes |
| 3859 | C -> T | Yes |
| 3862 | G -> C | Yes |
| 3870 | T -> A | Yes |
| 3873 | G -> C | Yes |
| 3875 | C -> T | Yes |
| 4027 | G -> A | Yes |
| 4034 | T -> C | Yes |
| 4115 | C -> G | Yes |

TABLE 183-continued

Nucleic acid SNPs

| SNP position on nucleotide sequence | Alternative nucleic acid | Previously known SNP? |
|---|---|---|
| 4120 | C -> T | Yes |
| 4129 | G -> T | Yes |
| 4130 | G -> C | Yes |
| 4226 | G -> A | Yes |
| 4232 | C -> G | Yes |
| 4235 | G -> A | Yes |
| 4356 | G -> T | Yes |
| 4449 | A -> T | Yes |
| 4668 | A -> G | No |
| 4760 | T -> C | Yes |
| 4894 | G -> | No |
| 5395 | C -> G | Yes |
| 5487 | C -> | Yes |
| 5511 | T -> C | Yes |
| 6050 | G -> C | No |
| 6093 | G -> A | Yes |
| 6103 | A -> C | Yes |
| 6278 | A -> C | Yes |
| 6284 | G -> A | Yes |
| 6349 | A -> C | Yes |
| 6407 | C -> T | Yes |
| 6672 | C -> T | Yes |
| 6691 | C -> T | Yes |
| 7424 | C -> A | Yes |
| 7644 | C -> T | Yes |
| 7809 | A -> C | Yes |

Variant protein HSCOC4_PEA_1_P30 (SEQ ID NO:353) according to the present invention has an amino acid sequence as given at the end of the application; it is encoded by transcript(s) HSCOC4_PEA_1_T40 (SEQ ID NO:33). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P30 (SEQ ID NO:353) and CO4_HUMAN_V3 (SEQ ID NO:390):

1. An isolated chimeric polypeptide encoding for HSCOC4_PEA_1_P30 (SEQ ID NO:353), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSV SVFVDHHLA PSFYFVAFYYHGDHPVANSLRVDVQA-GACEGKLELSVDGAKQYRNGESVKLHLETDS LAL-VALGALDTALYAAGSKSHKPLN- MGKVFEAMNSYDLGCGPGGGDSALQVFQAAG
LAFSDGDQWTLSRKRLSCPKEKT-
TRKKRNVNFQKAINEKLGQYASPTAKRCCQDGVTR
LPMMRSCEQRAARVQQPDCREPFLSCCQ-
FAESLRKKSRDKGQAGLQRALEILQEEDLID
EDDIPVRSFFPENWLWRVETVDRF-
QILTLWLPDSLTTWEIHGLSLSKTKGLCVATPVQL
RVFREFHLHLRLPMSVRRFEQLELRPV-
LYNYLDKNLTVSVHVSPVEGLCLAGGGGLAQ
QVLVPAGSARPVAFSVVPTAAAAVSLKV-
VARGSFEFPVGDAVSKVLQIEKEGAIHREEL VYELN-
PLDHRGRTLEIPGNSDPNMIPDGDFN-
SYVRVTASDPLDTLGSEGALSPGGVASL
LRLPRGCGEQTMIYLAPTLAASRYLDK-
TEQWSTLPPETKDHAVDLIQKGYMRIQQFRK
ADGSYAAWLSRDSSTWLTAFVLKV-
LSLAQEQVGGSPEKLQETSNWLLSQQQADGSFQ
DPCPVLDRSMQGGLVGNDETVALTAFV-
TIALHHGLAVFQDEGAEPLKQRVEASISKASS
FLGEKASAGLLGAHAAAITAYALTLTKA-
PADLRGVAHNNLMAMAQETGDNLYWGS corresponding to amino acids 1-1232 of CO4_HUMAN_V3 (SEQ ID NO:390), which also corresponds to amino acids 1-1232 of HSCOC4_PEA_1_P30 (SEQ ID NO:353), and a second amino acid sequence being at least 70%, optionally at least 80%, preferably at least 85%, more preferably at least 90% and most preferably at least 95% homologous to a polypeptide having the sequence RNPVRLLQPRAQMFCVL-RGTK (SEQ ID NO: 557) corresponding to amino acids 1233-1253 of HSCOC4_PEA_1_P30 (SEQ ID NO:353), wherein said first amino acid sequence and second amino acid sequence are contiguous and in a sequential order.

2. An isolated polypeptide encoding for a tail of HSCOC4_PEA_1_P30 (SEQ ID NO:353), comprising a polypeptide being at least 70%, optionally at least about 80%, preferably at least about 85%, more preferably at least about 90% and most preferably at least about 95% homologous to the sequence RNPVRLLQPRAQMFCVLRGTK (SEQ ID NO: 557) in HSCOC4_PEA_1_P30 (SEQ ID NO:353).

It should be noted that the known protein sequence (CO4_HUMAN) has one or more changes than the sequence given at the end of the application and named as being the amino acid sequence for CO4_HUMAN_V3 (SEQ ID NO:390). These changes were previously known to occur and are listed in the table below.

TABLE 184

Changes to CO4_HUMAN_V3 (SEQ ID NO:390)

| SNP position(s) on amino acid sequence | Type of change |
| --- | --- |
| 1177 | Variant |
| 1202 | Variant |
| 1208 | Variant |
| 1211 | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA_1_P30 (SEQ ID NO:353) also has the following non-silent SNPs (Single Nucleotide Polymorphisms) as listed in Table 185, (given according to their position(s) on the amino acid sequence, with the alternative amino acid(s) listed; the last column indicates whether the SNP is known or not; the presence of known SNPs in variant protein HSCOC4_PEA_1_P30 (SEQ ID NO:353) sequence provides support for the deduced sequence of this variant protein according to the present invention).

TABLE 185

Amino acid mutations

| SNP position(s) on amino acid sequence | Alternative amino acid(s) | Previously known SNP? |
| --- | --- | --- |
| 128 | Q -> | No |
| 141 | L -> V | Yes |
| 183 | G -> | No |
| 211 | G -> | No |
| 322 | A -> | No |
| 322 | A -> V | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |
| 726 | P -> L | Yes |
| 872 | V -> A | Yes |
| 907 | A -> T | Yes |
| 959 | E -> D | Yes |
| 1073 | D -> G | Yes |
| 1120 | P -> L | Yes |
| 1121 | C -> S | Yes |
| 1124 | L -> I | Yes |
| 1125 | D -> H | Yes |
| 1176 | S -> N | Yes |
| 1207 | A -> V | Yes |
| 1210 | R -> L | Yes |

Variant protein HSCOC4_PEA_1_P30 (SEQ ID NO:353) is encoded by the following transcript(s): HSCOC4_PEA_1_T40 (SEQ ID NO:33), for which the sequence(s) is/are given at the end of the application. The coding portion of transcript HSCOC4_PEA_1_T40 (SEQ ID NO:33) is shown in bold; this coding portion starts at position 501 and ends at position 4259. The transcript also has the following SNPs as listed in Table 186 (given according to their position on the nucleotide sequence, with the alternative nucleic acid listed; the last column indicates whether the SNP is known or not; the presence of known SNPs in variant protein HSCOC4_PEA_1_P30 (SEQ ID NO:353) sequence provides support for the deduced sequence of this variant protein according to the present invention).

TABLE 186

Nucleic acid SNPs

| SNP position on nucleotide sequence | Alternative nucleic acid | Previously known SNP? |
| --- | --- | --- |
| 304 | A -> G | Yes |
| 884 | G -> | No |
| 921 | C -> G | Yes |
| 1049 | C -> | No |

TABLE 186-continued

Nucleic acid SNPs

| SNP position on nucleotide sequence | Alternative nucleic acid | Previously known SNP? |
|---|---|---|
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |
| 2435 | G -> A | Yes |
| 2540 | C -> T | No |
| 2677 | C -> T | Yes |
| 2975 | C -> T | Yes |
| 3115 | T -> C | Yes |
| 3146 | G -> T | Yes |
| 3219 | G -> A | Yes |
| 3377 | A -> C | Yes |
| 3456 | T -> C | Yes |
| 3611 | G -> T | Yes |
| 3718 | A -> G | Yes |
| 3785 | C -> A | Yes |
| 3859 | C -> T | Yes |
| 3862 | G -> C | Yes |
| 3870 | T -> A | Yes |
| 3873 | G -> C | Yes |
| 3875 | C -> T | Yes |
| 4027 | G -> A | Yes |
| 4034 | T -> C | Yes |
| 4115 | C -> G | Yes |
| 4120 | C -> T | Yes |
| 4129 | G -> T | Yes |
| 4130 | G -> C | Yes |
| 4348 | C -> G | Yes |
| 4559 | G -> C | No |
| 4602 | G -> A | Yes |
| 4612 | A -> C | Yes |
| 4787 | A -> C | Yes |
| 4793 | G -> A | Yes |
| 4858 | A -> C | Yes |

Variant protein HSCOC4_PEA_1_P38 (SEQ ID NO:354) according to the present invention has an amino acid sequence as given at the end of the application; it is encoded by transcript(s) HSCOC4_PEA_1_T2 (SEQ ID NO:16). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P38 (SEQ ID NO:354) and CO4_HUMAN:

1. An isolated chimeric polypeptide encoding for HSCOC4_PEA_1_P38 (SEQ ID NO:354), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTS VSVFVDHHLA PSFYFVAFYYHGDHPVANSLRVD-VQAGACEGKLELSVDGAKQYRNGESVKLHLETDS LALVALGALDTALYAAGSKSHKPLN-MGKVFEAMNSYDLGCGPGGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKG corresponding to amino acids 1-818 of CO4_HUMAN, which also corresponds to amino acids 1-818 of HSCOC4_PEA_1_P38 (SEQ ID NO:354), and a second amino acid sequence being at least 70%, optionally at least 80%, preferably at least 85%, more preferably at least 90% and most preferably at least 95% homologous to a polypeptide having the sequence DVTLSGPQVTLLPFPCTPAPCSLCS (SEQ ID NO: 545) corresponding to amino acids 819-843 of HSCOC4_PEA_1_P38 (SEQ ID NO:354), wherein said first amino acid sequence and second amino acid sequence are contiguous and in a sequential order.

2. An isolated polypeptide encoding for a tail of HSCOC4_PEA_1_P38 (SEQ ID NO:354), comprising a polypeptide being at least 70%, optionally at least about 80%, preferably at least about 85%, more preferably at least about 90% and most preferably at least about 95% homologous to the sequence DVTLSGPQVTLLPFPCTPAPCSLCS (SEQ ID NO: 545) in HSCOC4_PEA_1_P38 (SEQ ID NO:354).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA_1_P38 (SEQ ID NO:354) also has the following non-silent SNPs (Single Nucleotide Polymorphisms) as listed in Table 187, (given according to their position(s) on the amino acid sequence, with the alternative amino acid(s) listed; the last column indicates whether the SNP is known or not; the presence of known SNPs in variant protein HSCOC4_PEA_1_P38 (SEQ ID NO:354) sequence provides support for the deduced sequence of this variant protein according to the present invention).

TABLE 187

Amino acid mutations

| SNP position(s) on amino acid sequence | Alternative amino acid(s) | Previously known SNP? |
|---|---|---|
| 128 | Q -> | No |
| 141 | L -> V | Yes |
| 183 | G -> | No |
| 211 | G -> | No |
| 322 | A -> | No |
| 322 | A -> V | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |
| 726 | P -> L | Yes |
| 829 | L -> P | Yes |
| 830 | L -> I | Yes |
| 840 | S -> P | Yes |

The glycosylation sites of variant protein HSCOC4_PEA_1_P38 (SEQ ID NO:354), as compared to the known protein Complement C4 precursor [Contains: C4a anaphylatoxin], are described in Table 188 (given according to their position(s) on the amino acid sequence in the first column; the second column indicates whether the glycosylation site is present in the variant protein; and the last column indicates whether the position is different on the variant protein).

TABLE 188

Glycosylation site(s)

| Position(s) on known amino acid sequence | Present in variant protein? | Position in variant protein? |
|---|---|---|
| 1391 | No | |
| 862 | No | |
| 226 | Yes | 226 |
| 1328 | No | |

The phosphorylation sites of variant protein HSCOC4_PEA_1_P38 (SEQ ID NO:354), as compared to the known protein Complement C4 precursor [Contains: C4a anaphylatoxin], are described in Table 189 (given according to their position(s) on the amino acid sequence in the first column; the second column indicates whether the phosphorylation site is present in the variant protein; and the last column indicates whether the position is different on the variant protein).

TABLE 189

Phosphorylation site(s)

| Position(s) on known amino acid sequence | Present in variant protein? | Position in variant protein? |
|---|---|---|
| 1420 | No | |
| 1422 | No | |
| 1417 | No | |

Variant protein HSCOC4_PEA_1_P38 (SEQ ID NO:354) is encoded by the following transcript(s): HSCOC4_PEA_1_T2 (SEQ ID NO:16), for which the sequence(s) is/are given at the end of the application. The coding portion of transcript HSCOC4_PEA_1_T2 (SEQ ID NO:16) is shown in bold; this coding portion starts at position 501 and ends at position 3029. The transcript also has the following SNPs as listed in Table 190 (given according to their position on the nucleotide sequence, with the alternative nucleic acid listed; the last column indicates whether the SNP is known or not; the presence of known SNPs in variant protein HSCOC4_PEA_1_P38 (SEQ ID NO:354) sequence provides support for the deduced sequence of this variant protein according to the present invention).

TABLE 190

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |
| 2435 | G -> A | Yes |
| 2540 | C -> T | No |
| 2677 | C -> T | Yes |
| 2986 | T -> C | Yes |
| 2988 | C -> A | Yes |
| 3018 | T -> C | Yes |
| 3070 | C -> T | Yes |
| 3081 | C -> A | Yes |
| 3093 | A -> G | Yes |
| 3101 | G -> A | Yes |
| 3106 | G -> A | Yes |
| 3174 | G -> A | Yes |
| 3193 | A -> G | Yes |
| 3201 | T -> C | Yes |
| 3233 | C -> T | Yes |
| 3373 | T -> C | Yes |
| 3404 | G -> T | Yes |
| 3477 | G -> A | Yes |
| 3635 | A -> C | Yes |
| 3714 | T -> C | Yes |
| 3869 | G -> T | Yes |
| 3976 | A -> G | Yes |
| 4043 | C -> A | Yes |
| 4117 | C -> T | Yes |
| 4120 | G -> C | Yes |
| 4128 | T -> A | Yes |
| 4131 | G -> C | Yes |
| 4133 | C -> T | Yes |
| 4285 | G -> A | Yes |
| 4292 | T -> C | Yes |
| 4373 | C -> G | Yes |
| 4378 | C -> T | Yes |
| 4387 | G -> T | Yes |
| 4388 | G -> C | Yes |
| 4484 | G -> A | Yes |
| 4490 | C -> G | Yes |
| 4493 | G -> A | Yes |
| 4614 | G -> T | Yes |
| 4707 | A -> T | Yes |
| 4926 | A -> G | No |
| 5018 | T -> C | Yes |
| 5152 | G -> | No |
| 5568 | C -> G | Yes |
| 5779 | G -> C | No |
| 5822 | G -> A | Yes |

TABLE 190-continued

Nucleic acid SNPs

| SNP position on nucleotide sequence | Alternative nucleic acid | Previously known SNP? |
|---|---|---|
| 5832 | A -> C | Yes |
| 6007 | A -> C | Yes |
| 6013 | G -> A | Yes |
| 6078 | A -> C | Yes |

Variant protein HSCOC4_PEA_1_P39 (SEQ ID NO:355) according to the present invention has an amino acid sequence as given at the end of the application; it is encoded by transcript(s) HSCOC4_PEA_1_T5 (SEQ ID NO:19). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P39 (SEQ ID NO:355) and CO4_HUMAN:

1. An isolated chimeric polypeptide encoding for HSCOC4_PEA_1_P39 (SEQ ID NO:355), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDTI TVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAPFLLQ corresponding to amino acids 1-387 of CO4_HUMAN, which also corresponds to amino acids 1-387 of HSCOC4_PEA_1_P39 (SEQ ID NO:355), and a second amino acid sequence being at least 70%, optionally at least 80%, preferably at least 85%, more preferably at least 90% and most preferably at least 95% homologous to a polypeptide having the sequence VSSRGEG (SEQ ID NO: 559) corresponding to amino acids 388-394 of HSCOC4_PEA_1_P39 (SEQ ID NO:355), wherein said first amino acid sequence and second amino acid sequence are contiguous and in a sequential order.

2. An isolated polypeptide encoding for a tail of HSCOC4_PEA_1_P39 (SEQ ID NO:355), comprising a polypeptide being at least 70%, optionally at least about 80%, preferably at least about 85%, more preferably at least about 90% and most preferably at least about 95% homologous to the sequence VSSRGEG (SEQ ID NO: 559) in HSCOC4_PEA_1_P39 (SEQ ID NO:355).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA_1_P39 (SEQ ID NO:355) also has the following non-silent SNPs (Single Nucleotide Polymorphisms) as listed in Table 191, (given according to their position(s) on the amino acid sequence, with the alternative amino acid(s) listed; the last column indicates whether the SNP is known or not; the presence of known SNPs in variant protein HSCOC4_PEA_1_P39 (SEQ ID NO:355) sequence provides support for the deduced sequence of this variant protein according to the present invention).

TABLE 191

Amino acid mutations

| SNP position(s) on amino acid sequence | Alternative amino acid(s) | Previously known SNP? |
|---|---|---|
| 128 | Q -> | No |
| 141 | L -> V | Yes |
| 183 | G -> | No |
| 211 | G -> | No |
| 322 | A -> | No |
| 322 | A -> V | No |
| 347 | S -> Y | Yes |

The glycosylation sites of variant protein HSCOC4_PEA_1_P39 (SEQ ID NO:355), as compared to the known protein Complement C4 precursor [Contains: C4a anaphylatoxin], are described in Table 192 (given according to their position(s) on the amino acid sequence in the first column; the second column indicates whether the glycosylation site is present in the variant protein; and the last column indicates whether the position is different on the variant protein).

TABLE 192

Glycosylation site(s)

| Position(s) on known amino acid sequence | Present in variant protein? | Position in variant protein? |
|---|---|---|
| 1391 | No | |
| 862 | No | |
| 226 | Yes | 226 |
| 1328 | No | |

The phosphorylation sites of variant protein HSCOC4_PEA_1_P39 (SEQ ID NO:355), as compared to the known protein Complement C4 precursor [Contains: C4a anaphylatoxin], are described in Table 193 (given according to their position(s) on the amino acid sequence in the first column; the second column indicates whether the phosphorylation site is present in the variant protein; and the last column indicates whether the position is different on the variant protein).

TABLE 193

Phosphorylation site(s)

| Position(s) on known amino acid sequence | Present in variant protein? |
|---|---|
| 1420 | No |
| 1422 | No |
| 1417 | No |

Variant protein HSCOC4_PEA_1_P39 (SEQ ID NO:355) is encoded by the following transcript(s): HSCOC4_PEA_1_T5 (SEQ ID NO:19), for which the sequence(s) is/are given at the end of the application. The coding portion of transcript HSCOC4_PEA_1_T5 (SEQ ID NO:19) is shown in bold; this coding portion starts at position 501 and ends at position 1682. The transcript also has the following SNPs as listed in Table 194 (given according to their position on the nucleotide sequence, with the alternative nucleic acid listed; the last column indicates whether the SNP is known or not; the presence of known SNPs in variant protein HSCOC_C4_PEA_1_P39 (SEQ ID NO:355) sequence provides support for the deduced sequence of this variant protein according to the present invention).

TABLE 194

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1742 | C -> A | Yes |
| 1756 | C -> A | Yes |
| 1867 | A -> | No |
| 1877 | C -> T | Yes |
| 2032 | C -> T | Yes |
| 2084 | C -> T | Yes |
| 2245 | A -> C | Yes |
| 2261 | G -> A | Yes |
| 2421 | C -> G | Yes |
| 2448 | A -> G | Yes |
| 2534 | G -> A | Yes |
| 2639 | C -> T | No |
| 2776 | C -> T | Yes |
| 3074 | C -> T | Yes |
| 3214 | T -> C | Yes |
| 3245 | G -> T | Yes |
| 3318 | G -> A | Yes |
| 3476 | A -> C | Yes |
| 3555 | T -> C | Yes |
| 3710 | G -> T | Yes |
| 3817 | A -> G | Yes |
| 3884 | C -> A | Yes |
| 3958 | C -> T | Yes |
| 3961 | G -> C | Yes |
| 3969 | T -> A | Yes |
| 3972 | G -> C | Yes |
| 3974 | C -> T | Yes |
| 4126 | G -> A | Yes |
| 4133 | T -> C | Yes |
| 4214 | C -> G | Yes |
| 4219 | C -> T | Yes |
| 4228 | G -> T | Yes |
| 4229 | G -> C | Yes |
| 4325 | G -> A | Yes |
| 4331 | C -> G | Yes |
| 4334 | G -> A | Yes |
| 4455 | G -> T | Yes |
| 4548 | A -> T | Yes |
| 4767 | A -> G | No |
| 4859 | T -> C | Yes |
| 4993 | G -> | No |
| 5409 | C -> G | Yes |
| 5620 | G -> C | No |
| 5663 | G -> A | Yes |
| 5673 | A -> C | Yes |
| 5848 | A -> C | Yes |

TABLE 194-continued

Nucleic acid SNPs

| SNP position on nucleotide sequence | Alternative nucleic acid | Previously known SNP? |
|---|---|---|
| 5854 | G -> A | Yes |
| 5919 | A -> C | Yes |

Variant protein HSCOC4_PEA_1_P40 (SEQ ID NO:356) according to the present invention has an amino acid sequence as given at the end of the application; it is encoded by transcript(s) HSCOC4_PEA_1_T7 (SEQ ID NO:20). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P40 (SEQ ID NO:356) and CO4_HUMAN:

1. An isolated chimeric polypeptide encoding for HSCOC4_PEA_1_P40 (SEQ ID NO:356), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTD TITVMV ENSHGLRVRKKEVYMPSSIFQDDFVIP-DISEPGTWKISARFSDGLESNSSTQFEVKKY corresponding to amino acids 1-236 of CO4_HUMAN, which also corresponds to amino acids 1-236 of HSCOC4_PEA_1_P40 (SEQ ID NO:356), and a second amino acid sequence being at least 70%, optionally at least 80%, preferably at least 85%, more preferably at least 90% and most preferably at least 95% homologous to a polypeptide having the sequence AGEWTEPHFPLKGRVPGRPGEAEYGHY (SEQ ID NO: 560) corresponding to amino acids 237-263 of HSCOC4_PEA_1_P40 (SEQ ID NO:356), wherein said first amino acid sequence and second amino acid sequence are contiguous and in a sequential order.

2. An isolated polypeptide encoding for a tail of HSCOC4_PEA_1_P40 (SEQ ID NO:356), comprising a polypeptide being at least 70%, optionally at least about 80%, preferably at least about 85%, more preferably at least about 90% and most preferably at least about 95% homologous to the sequence AGEWTEPHFPLKGRVPGRPGE-AEYGHY (SEQ ID NO: 560) in HSCOC4_PEA_1_P40 (SEQ ID NO:356).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA_1_P40 (SEQ ID NO:356) also has the following non-silent SNPs (Single Nucleotide Polymorphisms) as listed in Table 195, (given according to their position(s) on the amino acid sequence, with the alternative amino acid(s) listed; the last column indicates whether the SNP is known or not; the presence of known SNPs in variant protein HSCOC4_PEA_1_P40 (SEQ ID NO:356) sequence provides support for the deduced sequence of this variant protein according to the present invention).

TABLE 195

Amino acid mutations

| SNP position(s) on amino acid sequence | Alternative amino acid(s) | Previously known SNP? |
|---|---|---|
| 128 | Q -> | No |
| 141 | L -> V | Yes |
| 183 | G -> | No |
| 211 | G -> | No |
| 254 | R -> | No |

The glycosylation sites of variant protein HSCOC4_PEA_1_P40 (SEQ ID NO:356), as compared to the known protein Complement C4 precursor [Contains: C4a anaphylatoxin], are described in Table 196 (given according to their position(s) on the amino acid sequence in the first column; the second column indicates whether the glycosylation site is present in the variant protein; and the last column indicates whether the position is different on the variant protein).

TABLE 196

Glycosylation site(s)

| Position(s) on known amino acid sequence | Present in variant protein? | Position in variant protein? |
|---|---|---|
| 1391 | No | |
| 862 | No | |
| 226 | Yes | 226 |
| 1328 | No | |

The phosphorylation sites of variant protein HSCOC4_PEA_1_P40 (SEQ ID NO:356), as compared to the known protein Complement C4 precursor [Contains: C4a anaphylatoxin], are described in Table 197 (given according to their position(s) on the amino acid sequence in the first column; the second column indicates whether the phosphorylation site is present in the variant protein; and the last column indicates whether the position is different on the variant protein).

TABLE 197

Phosphorylation site(s)

| Position(s) on known amino acid sequence | Present in variant protein? |
|---|---|
| 1420 | No |
| 1422 | No |
| 1417 | No |

Variant protein HSCOC4_PEA_1_P40 (SEQ ID NO:356) is encoded by the following transcript(s): HSCOC4_PEA_1_T7 (SEQ ID NO:20), for which the sequence(s) is/are given at the end of the application. The coding portion of transcript HSCOC4_PEA_1_T7 (SEQ ID NO:20) is shown in bold; this coding portion starts at position 501 and ends at position 1289. The transcript also has the following SNPs as listed in Table 198 (given according to their position on the nucleotide sequence, with the alternative nucleic acid listed; the last column indicates whether the SNP is known or not; the presence of known SNPs in variant protein HSCOC4_PEA_1_P40 (SEQ ID NO:356) sequence provides support for the deduced sequence of this variant protein according to the present invention).

TABLE 198

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1262 | C -> | No |
| 1262 | C -> T | No |
| 1314 | C -> T | Yes |
| 1337 | C -> A | Yes |
| 1565 | A -> | No |
| 1575 | C -> T | Yes |
| 1730 | C -> T | Yes |
| 1782 | C -> T | Yes |
| 1943 | A -> C | Yes |
| 1959 | G -> A | Yes |
| 2119 | C -> G | Yes |
| 2146 | A -> G | Yes |
| 2232 | G -> A | Yes |
| 2337 | C -> T | No |
| 2474 | C -> T | Yes |
| 2772 | C -> T | Yes |
| 2912 | T -> C | Yes |
| 2943 | G -> T | Yes |
| 3016 | G -> A | Yes |
| 3174 | A -> C | Yes |
| 3253 | T -> C | Yes |
| 3408 | G -> T | Yes |
| 3515 | A -> G | Yes |
| 3582 | C -> A | Yes |
| 3656 | C -> T | Yes |
| 3659 | G -> C | Yes |
| 3667 | T -> A | Yes |
| 3670 | G -> C | Yes |
| 3672 | C -> T | Yes |
| 3824 | G -> A | Yes |
| 3831 | T -> C | Yes |
| 3912 | C -> G | Yes |
| 3917 | C -> T | Yes |
| 3926 | G -> T | Yes |
| 3927 | G -> C | Yes |
| 4023 | G -> A | Yes |
| 4029 | C -> G | Yes |
| 4032 | G -> A | Yes |
| 4153 | G -> T | Yes |
| 4246 | A -> T | Yes |
| 4465 | A -> G | No |
| 4557 | T -> C | Yes |
| 4691 | G -> | No |
| 5107 | C -> G | Yes |
| 5318 | G -> C | No |
| 5361 | G -> A | Yes |
| 5371 | A -> C | Yes |
| 5546 | A -> C | Yes |
| 5552 | G -> A | Yes |
| 5617 | A -> C | Yes |

Variant protein HSCOC4_PEA_1_P41 (SEQ ID NO:357) according to the present invention has an amino acid sequence as given at the end of the application; it is encoded by transcript(s) HSCOC4_PEA_1_T8 (SEQ ID NO:21). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P41 (SEQ ID NO:357) and CO4_HUMAN_V1 (SEQ ID NO:389):

1. An isolated chimeric polypeptide encoding for HSCOC4_PEA_1_P41 (SEQ ID NO:357), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-GACEGKLELSVDGAKQYRNGESVKLHLETDS LAL-VALGALDTALYAAGSKSHKPLN-MGKVFEAMNSYDLGCGPGGDSALQVFQAAG LAFSDGDQWTLSRKRLSCPKEKT-TRKKRNVNFQKAINEKLGQYASPTAKRCCQDGVTR LPMMRSCEQRAARVQQPDCREPFLSCCQ-FAESLRKKSRDKGQAGLQRALEILQEEDLID EDDIPVRSFFPENWLWRVETVDRF-QILTLWLPDSLTTWEIHGLSLSKTKGLCVATPVQL RVFREFHLHLRLPMSVRRFEQLELRPV-LYNYLDKNLTVSVHVSPVEGLCLAGGGGLAQ QVLVPAGSARPVAFSVVPTAAAAVSLKV-VARGSFEFPVGDAVSKVLQIEKEGAIHREEL VYELN-PLDHRGRTLEIPGNSDPNMIPDGDFN-SYVRVTASDPLDTLGSEGALSPGGVASL LRLPRGCGEQTMIYLAPTLAASRYLDK-TEQWSTLPPETKDHAVDLIQKGYMRIQQFRK ADGSYAAWLSRDSSTWLTAFVLKV-LSLAQEQVGGSPEKLQETSNWLLSQQQADGSFQ DPCPVLDRSMQGGLVGNDETVALTAFV-TIALHHGLAVFQDEGAEPLKQRVEASISKASS FLGEKASAGLLGAHAAAITAYALTLTKA-PADLRGVAHNNLMAMAQETGDNLYWGSV TGSQS-NAVSPTPAPRNPSDPMPQAPALWIET-TAYALLHLLLHEGKAEMADQAAAWLTR QGSFQGGFRSTQDTVIALDALSAY-WIASHTTEERGLNVTLSSTGRNGFKSHALQLNNRQ IRGLEEELQFSLGSKINVKVGGN-SKGTLKVLRTYNVLDMKNTTCQDLQIEVTVKGHVE YTMEANEDYEDYEYDELPAKDDPDA-PLQPVTPLQLFEGRRNRRRREAPKVVEEQESRV HYTVCIWRNGKVGLSGMAIADVTLLSGF-HALRADLEKLTSLSDRYVSHFETEGPHVLL YFDSV corresponding to amino acids 1-1529 of CO4_HUMAN_VI (SEQ ID NO:389), which also corresponds to amino acids 1-1529 of HSCOC4_PEA_1_P41 (SEQ ID NO:357), and a second amino acid sequence being at least 70%, optionally at least 80%, preferably at least 85%, more preferably at least 90% and most preferably at least 95% homologous to a polypeptide having the sequence SGER (SEQ ID NO: 551) corresponding to amino acids 1530-1533 of HSCOC4_PEA_1_P41 (SEQ ID NO:357), wherein said first amino acid sequence and second amino acid sequence are contiguous and in a sequential order.

2. An isolated polypeptide encoding for a tail of HSCOC4_PEA_1_P41 (SEQ ID NO:357), comprising a polypeptide being at least 70%, optionally at least about 80%, preferably at least about 85%, more preferably at least about 90% and most preferably at least about 95% homologous to the sequence SGER (SEQ ID NO: 551) in HSCOC4_PEA_1_P41 (SEQ ID NO:357).

It should be noted that the known protein sequence (CO4_HUMAN) has one or more changes than the sequence given at the end of the application and named as being the amino acid sequence for CO4_HUMAN_V1 (SEQ ID NO:389). These changes were previously known to occur and are listed in the table below.

TABLE 199

| Changes to CO4_HUMAN_V1 (SEQ ID NO:389) | |
|---|---|
| SNP position(s) on amino acid sequence | Type of change |
| 1177 | Variant |
| 1202 | Variant |
| 1208 | Variant |
| 1211 | Variant |
| 1287 | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because of manual inspection of known protein localization and/or gene structure.

Variant protein HSCOC4_PEA_1_P41 (SEQ ID NO:357) also has the following non-silent SNPs (Single Nucleotide Polymorphisms) as listed in Table 200, (given according to their position(s) on the amino acid sequence, with the alternative amino acid(s) listed; the last column indicates whether the SNP is known or not; the presence of known SNPs in variant protein HSCOC4_PEA_1_P41 (SEQ ID NO:357) sequence provides support for the deduced sequence of this variant protein according to the present invention).

TABLE 200

| Amino acid mutations | | |
|---|---|---|
| SNP position(s) on amino acid sequence | Alternative amino acid(s) | Previously known SNP? |
| 128 | Q -> | No |
| 141 | L -> V | Yes |
| 183 | G -> | No |
| 211 | G -> | No |
| 322 | A -> V | No |
| 322 | A -> | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |

TABLE 200-continued

Amino acid mutations

| SNP position(s) on amino acid sequence | Alternative amino acid(s) | Previously known SNP? |
|---|---|---|
| 726 | P -> L | Yes |
| 872 | V -> A | Yes |
| 907 | A -> T | Yes |
| 959 | E -> D | Yes |
| 1073 | D -> G | Yes |
| 1120 | P -> L | Yes |
| 1121 | C -> S | Yes |
| 1124 | L -> I | Yes |
| 1125 | D -> H | Yes |
| 1176 | S -> N | Yes |
| 1207 | A -> V | Yes |
| 1210 | R -> L | Yes |
| 1286 | A -> S | Yes |
| 1317 | I -> F | Yes |
| 1390 | K -> E | No |
| 1465 | R -> | No |

Variant protein HSCOC4_PEA_1_P41 (SEQ ID NO:357) is encoded by the following transcript(s): HSCOC4_PEA_1_T8 (SEQ ID NO:21), for which the sequence(s) is/are given at the end of the application. The coding portion of transcript HSCOC4_PEA_1_T8 (SEQ ID NO:21) is shown in bold; this coding portion starts at position 501 and ends at position 5099. The transcript also has the following SNPs as listed in Table 201 (given according to their position on the nucleotide sequence, with the alternative nucleic acid listed; the last column indicates whether the SNP is known or not; the presence of known SNPs in variant protein HSCOC4_PEA_1_P41 (SEQ ID NO:357) sequence provides support for the deduced sequence of this variant protein according to the present invention).

TABLE 201

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |
| 2435 | G -> A | Yes |
| 2540 | C -> T | No |
| 2677 | C -> T | Yes |
| 2975 | C -> T | Yes |
| 3115 | T -> C | Yes |
| 3146 | G -> T | Yes |
| 3219 | G -> A | Yes |
| 3377 | A -> C | Yes |
| 3456 | T -> C | Yes |
| 3611 | G -> T | Yes |
| 3718 | A -> G | Yes |
| 3785 | C -> A | Yes |

TABLE 201-continued

Nucleic acid SNPs

| SNP position on nucleotide sequence | Alternative nucleic acid | Previously known SNP? |
|---|---|---|
| 3859 | C -> T | Yes |
| 3862 | G -> C | Yes |
| 3870 | T -> A | Yes |
| 3873 | G -> C | Yes |
| 3875 | C -> T | Yes |
| 4027 | G -> A | Yes |
| 4034 | T -> C | Yes |
| 4115 | C -> G | Yes |
| 4120 | C -> T | Yes |
| 4129 | G -> T | Yes |
| 4130 | G -> C | Yes |
| 4226 | G -> A | Yes |
| 4232 | C -> G | Yes |
| 4235 | G -> A | Yes |
| 4356 | G -> T | Yes |
| 4449 | A -> T | Yes |
| 4668 | A -> G | No |
| 4760 | T -> C | Yes |
| 4894 | G -> | No |
| 5561 | G -> A | Yes |
| 6026 | T -> G | Yes |
| 6348 | G -> C | Yes |
| 6801 | C -> G | Yes |
| 7012 | G -> C | No |
| 7055 | G -> A | Yes |
| 7065 | A -> C | Yes |
| 7240 | A -> C | Yes |
| 7246 | G -> A | Yes |
| 7311 | A -> C | Yes |

Variant protein HSCOC4_PEA_1_P42 (SEQ ID NO:358) according to the present invention has an amino acid sequence as given at the end of the application; it is encoded by transcript(s) HSCOC4_PEA_1_T12 (SEQ ID NO:23). An alignment is given to the known protein (Complement C4 precursor [Contains: C4a anaphylatoxin]) at the end of the application. One or more alignments to one or more previously published protein sequences are given at the end of the application. A brief description of the relationship of the variant protein according to the present invention to each such aligned protein is as follows:

Comparison report between HSCOC4_PEA_1_P42 (SEQ ID NO:358) and CO4_HUMAN_V1 (SEQ ID NO:389):

1. An isolated chimeric polypeptide encoding for HSCOC4_PEA_1_P42 (SEQ ID NO:358), comprising a first amino acid sequence being at least 90% homologous to MRLLWGLIWASSFFTLSLQKPRLLLF-SPSVVHLGVPLSVGVQLQDVPRGQVVKGSVFLR NPSRNNVPCSPKVDFTLSSERD-FALLSLQVPLKDAKSCGLHQLLRGPE-VQLVAHSPWLK DSLSRTTNIQGINLLFSSR-RGHLFLQTDQPIYNPGQRVRYRVFALDQKMRPSTDT ITVMV ENSHGLRVRKKEVYMPSSIFQDDFVIP-DISEPGTWKISARFSDGLESNSSTQFEVKKYVL PNFE-VKITPGKPYILTVPGHLDEMQLDIQARY-IYGKPVQGVAYVRFGLLDEDGKKTFFR GLESQTKLVNGQSHISLSKAEFQDALEK-LNMGITDLQGLRLYVAAAIIESPGGEMEEAE LTSWY-FVSSPFSLDLSKTKRHLVPGAP-FLLQALVREMSGSPASGIPVKVSATVSSPGSVP EVQDIQQNTDGSGQVSIPIIIPQ-TISELQLSVSAGSPHPAIAR-LTVAAPPSGGPGFLSIERPD SRPPRVGDTLNLNL-RAVGSGATFSHYYYMILSRGQIVFMNREPKRTLTSVS VFVDHHLA PSFYFVAFYYHGDHPVANSLRVDVQA-
GACEGKLELSVDGAKQYRNGESVKLHLETDS LAL-
VALGALDTALYAAGSKSHKPLN-
MGKVFEAMNSYDLGCGPGGGDSALQVFQAAG
LAFSDGDQWTLSRKRLSCPKEKT-
TRKKRNVNFQKAINEKLGQYASPTAKRCCQDGVTR
LPMMRSCEQRAARVQQPDCREPFLSCCQ-
FAESLRKKSRDKGQAGLQRALEILQEEDLID
EDDIPVRSFFPENWLWRVETVDRF-
QILTLWLPDSLTTWEIHGLSLSKTKGLCVATPVQL
RVFREFHLHLRLPMSVRRFEQLELRPV-
LYNYLDKNLTVSVHVSPVEGLCLAGGGGLAQ
QVLVPAGSARPVAFSVVPTAAAAVSLKV-
VARGSFEFPVGDAVSKVLQIEKEGAIHREEL VYELN-
PLDHRGRTLEIPGNSDPNMIPDGDFN-
SYVRVTASDPLDTLGSEGALSPGGVASL
LRLPRGCGEQTMIYLAPTLAASRYLDK-
TEQWSTLPPETKDHAVDLIQKGYMRIQQFRK
ADGSYAAWLSRDSSTWLTAFVLKV-
LSLAQEQVGGSPEKLQETSNWLLSQQQADGSFQ
DPCPVLDRSMQGGLVGNDETVALTAFV-
TIALHHGLAVFQDEGAEPLKQRVEASISKASS
FLGEKASAGLLGAHAAAITAYALTLTKA-
PADLRGVAHNNLMAMAQETGDNLYWGSV TGSQS-
NAVSPTPAPRNPSDPMPQAPALWIET-
TAYALLHLLLHEGKAEMADQAAAWLTR
QGSFQGGFRSTQDTVIALDALSAY-
WIASHTTEERGLNVTLSSTGRNGFKSHALQLNNRQ
IRGLEEELQFSLGSKINVKVGGN-
SKGTLKVLRTYNVLDMKNTTCQDLQIEVTVKGHVE
YTMEANEDYEDYEYDELPAKDDPDA-
PLQPVTPLQLFEGRRNRRRREAPKVVEEQESRV
HYTVCIW corresponding to amino acids 1-1473 of CO4_HUMAN_V1 (SEQ ID NO:389), which also corresponds to amino acids 1-1473 of HSCOC4_PEA_1_P42 (SEQ ID NO:358), a second amino acid sequence being at least 70%, optionally at least 80%, preferably at least 85%, more preferably at least 90% and most preferably at least 95% homologous to a polypeptide having the sequence WAPGAALGQGREGRTQA-
GAGLLEPAQAEPGRQLTRLHR (SEQ ID NO: 562) corresponding to amino acids 1474-1511 of HSCOC4_PEA_1_P42 (SEQ ID NO:358), a third amino acid sequence being at least 90% homologous to RNGKVGLSGMAIAD-
VTLLSGFHALRADLEK corresponding to amino acids 1474-1503 of CO4_HUMAN_V1 (SEQ ID NO:389), which also corresponds to amino acids 1512-1541 of HSCOC4_PEA_1_P42 (SEQ ID NO:358), and a fourth amino acid sequence being at least 70%, optionally at least 80%, preferably at least 85%, more preferably at least 90% and most preferably at least 95% homologous to a polypeptide having the sequence VWSATQGNPLCPRY (SEQ ID NO: 563) corresponding to amino acids 1542-1555 of HSCOC4_PEA_1_P42 (SEQ ID NO:358), wherein said first amino acid sequence, second amino acid sequence, third amino acid sequence and fourth amino acid sequence are contiguous and in a sequential order.

2. An isolated polypeptide encoding for an edge portion of HSCOC4_PEA_1_P42 (SEQ ID NO:358), comprising an amino acid sequence being at least 70%, optionally at least about 80%, preferably at least about 85%, more preferably at least about 90% and most preferably at least about 95% homologous to the sequence encoding for WAPGAAL-
GQGREGRTQAGAGLLEPAQAEPGRQLTRLHR (SEQ ID NO: 562), corresponding to HSCOC4_PEA_1_P42 (SEQ ID NO:358).

3. An isolated polypeptide encoding for a tail of HSCOC4_PEA_1_P42 (SEQ ID NO:358), comprising a polypeptide being at least 70%, optionally at least about 80%, preferably at least about 85%, more preferably at least about 90% and most preferably at least about 95% homologous to the sequence VWSATQGNPLCPRY (SEQ ID NO: 563) in HSCOC4_PEA_1_P42 (SEQ ID NO:358).

It should be noted that the known protein sequence (CO4_HUMAN) has one or more changes than the sequence given at the end of the application and named as being the amino acid sequence for CO4_HUMAN_V1 (SEQ ID NO:389). These changes were previously known to occur and are listed in the table below.

TABLE 202

Changes to CO4_HUMAN_V1 (SEQ ID NO:389)

| SNP position(s) on amino acid sequence | Type of change |
| --- | --- |
| 1177 | Variant |
| 1202 | Variant |
| 1208 | Variant |
| 1211 | Variant |
| 1287 | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSCOC4_PEA_1_P42 (SEQ ID NO:358) also has the following non-silent SNPs (Single Nucleotide Polymorphisms) as listed in Table 203, (given according to their position(s) on the amino acid sequence, with the alternative amino acid(s) listed; the last column indicates whether the SNP is known or not; the presence of known SNPs in variant protein HSCOC4_PEA_1_P42 (SEQ ID NO:358) sequence provides support for the deduced sequence of this variant protein according to the present invention).

TABLE 203

Amino acid mutations

| SNP position(s) on amino acid sequence | Alternative amino acid(s) | Previously known SNP? |
| --- | --- | --- |
| 128 | Q -> | No |
| 141 | L -> V | Yes |
| 183 | G -> | No |
| 211 | G -> | No |
| 322 | A -> V | No |
| 322 | A -> | No |
| 347 | S -> Y | Yes |
| 423 | Q -> | No |
| 478 | P -> L | Yes |
| 549 | H -> P | Yes |
| 608 | L -> V | Yes |
| 617 | K -> E | Yes |
| 726 | P -> L | Yes |
| 872 | V -> A | Yes |
| 907 | A -> T | Yes |
| 959 | E -> D | Yes |
| 1073 | D -> G | Yes |

TABLE 203-continued

Amino acid mutations

| SNP position(s) on amino acid sequence | Alternative amino acid(s) | Previously known SNP? |
|---|---|---|
| 1120 | P -> L | Yes |
| 1121 | C -> S | Yes |
| 1124 | L -> I | Yes |
| 1125 | D -> H | Yes |
| 1176 | S -> N | Yes |
| 1207 | A -> V | Yes |
| 1210 | R -> L | Yes |
| 1286 | A -> S | Yes |
| 1317 | I -> F | Yes |
| 1390 | K -> E | No |
| 1465 | R -> | No |

Variant protein HSCOC4_PEA_1_P42 (SEQ ID NO:358) is encoded by the following transcript(s): HSCOC4_PEA_1_T12 (SEQ ID NO:23), for which the sequence(s) is/are given at the end of the application. The coding portion of transcript HSCOC4_PEA_1_T12 (SEQ ID NO:23) is shown in bold; this coding portion starts at position 501 and ends at position 5165. The transcript also has the following SNPs as listed in Table 204 (given according to their position on the nucleotide sequence, with the alternative nucleic acid listed; the last column indicates whether the SNP is known or not; the presence of known SNPs in variant protein HSCOC4_PEA_1_P42 (SEQ ID NO:358) sequence provides support for the deduced sequence of this variant protein according to the present invention).

TABLE 204

Nucleic acid SNPs

| SNP position on nucleotide sequence | Alternative nucleic acid | Previously known SNP? |
|---|---|---|
| 304 | A -> G | Yes |
| 884 | G -> | No |
| 921 | C -> G | Yes |
| 1049 | C -> | No |
| 1131 | G -> | No |
| 1465 | C -> | No |
| 1465 | C -> T | No |
| 1517 | C -> T | Yes |
| 1540 | C -> A | Yes |
| 1768 | A -> | No |
| 1778 | C -> T | Yes |
| 1933 | C -> T | Yes |
| 1985 | C -> T | Yes |
| 2146 | A -> C | Yes |
| 2162 | G -> A | Yes |
| 2322 | C -> G | Yes |
| 2349 | A -> G | Yes |
| 2435 | G -> A | Yes |
| 2540 | C -> T | No |
| 2677 | C -> T | Yes |
| 2975 | C -> T | Yes |
| 3115 | T -> C | Yes |
| 3146 | G -> T | Yes |
| 3219 | G -> A | Yes |
| 3377 | A -> C | Yes |
| 3456 | T -> C | Yes |
| 3611 | G -> T | Yes |
| 3718 | A -> G | Yes |
| 3785 | C -> A | Yes |
| 3859 | C -> T | Yes |
| 3862 | G -> C | Yes |
| 3870 | T -> A | Yes |
| 3873 | G -> C | Yes |
| 3875 | C -> T | Yes |

TABLE 204-continued

Nucleic acid SNPs

| SNP position on nucleotide sequence | Alternative nucleic acid | Previously known SNP? |
|---|---|---|
| 4027 | G -> A | Yes |
| 4034 | T -> C | Yes |
| 4115 | C -> G | Yes |
| 4120 | C -> T | Yes |
| 4129 | G -> T | Yes |
| 4130 | G -> C | Yes |
| 4226 | G -> A | Yes |
| 4232 | C -> G | Yes |
| 4235 | G -> A | Yes |
| 4356 | G -> T | Yes |
| 4449 | A -> T | Yes |
| 4668 | A -> G | No |
| 4760 | T -> C | Yes |
| 4894 | G -> | No |
| 5765 | G -> A | Yes |
| 6230 | T -> G | Yes |
| 6552 | G -> C | Yes |
| 7005 | C -> G | Yes |
| 7216 | G -> C | No |
| 7259 | G -> A | Yes |
| 7269 | A -> C | Yes |
| 7444 | A -> C | Yes |
| 7450 | G -> A | Yes |
| 7515 | A -> C | Yes |

As noted above, cluster HSCOC4 features 79 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSCOC4_PEA_1_node_1 (SEQ ID NO:143) according to the present invention is supported by 24 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO: 17), HSCOC4_PEA_1_T4 (SEQ ID NO:18), HSCOC4_PEA_1_T5 (SEQ ID NO: 19), HSCOC4_PEA_1_T7 (SEQ ID NO:20), HSCOC4_PEA_1_T8 (SEQ ID NO: 21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 205 below describes the starting and ending position of this segment on each transcript.

TABLE 205

Segment location on transcripts

| Transcript name | Segment starting position | Segment ending position |
|---|---|---|
| HSCOC4_PEA_1_T1 (SEQ ID NO:15) | 1 | 535 |
| HSCOC4_PEA_1_T2 (SEQ ID NO:16) | 1 | 535 |

TABLE 205-continued

Segment location on transcripts

| Transcript name | Segment starting position | Segment ending position |
|---|---|---|
| HSCOC4_PEA_1_T3 (SEQ ID NO:17) | 1 | 535 |
| HSCOC4_PEA_1_T4 (SEQ ID NO:18) | 1 | 535 |
| HSCOC4_PEA_1_T5 (SEQ ID NO:19) | 1 | 535 |
| HSCOC4_PEA_1_T7 (SEQ ID NO:20) | 1 | 535 |
| HSCOC4_PEA_1_T8 (SEQ ID NO:21) | 1 | 535 |
| HSCOC4_PEA_1_T11 (SEQ ID NO:22) | 1 | 535 |
| HSCOC4_PEA_1_T12 (SEQ ID NO:23) | 1 | 535 |
| HSCOC4_PEA_1_T14 (SEQ ID NO:24) | 1 | 535 |
| HSCOC4_PEA_1_T15 (SEQ ID NO:25) | 1 | 535 |
| HSCOC4_PEA_1_T20 (SEQ ID NO:26) | 1 | 535 |
| HSCOC4_PEA_1_T21 (SEQ ID NO:27) | 1 | 535 |
| HSCOC4_PEA_1_T25 (SEQ ID NO:28) | 1 | 535 |
| HSCOC4_PEA_1_T28 (SEQ ID NO:29) | 1 | 535 |
| HSCOC4_PEA_1_T30 (SEQ ID NO:30) | 1 | 535 |
| HSCOC4_PEA_1_T31 (SEQ ID NO:31) | 1 | 535 |
| HSCOC4_PEA_1_T32 (SEQ ID NO:32) | 1 | 535 |
| HSCOC4_PEA_1_T40 (SEQ ID NO:33) | 1 | 535 |

Segment cluster HSCOC4_PEA_1_node_5 (SEQ ID NO:144) according to the present invention is supported by 29 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO: 19), HSCOC4_PEA_1_T7 (SEQ ID NO:20), HSCOC4_PEA_1_T8 (SEQ ID NO: 21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 206 below describes the starting and ending position of this segment on each transcript.

TABLE 206

Segment location on transcripts

| Transcript name | Segment starting position | Segment ending position |
|---|---|---|
| HSCOC4_PEA_1_T1 (SEQ ID NO:15) | 566 | 764 |
| HSCOC4_PEA_1_T2 (SEQ ID NO:16) | 566 | 764 |

TABLE 206-continued

Segment location on transcripts

| Transcript name | Segment starting position | Segment ending position |
|---|---|---|
| HSCOC4_PEA_1_T3 (SEQ ID NO:17) | 566 | 764 |
| HSCOC4_PEA_1_T4 (SEQ ID NO:18) | 566 | 764 |
| HSCOC4_PEA_1_T5 (SEQ ID NO:19) | 566 | 764 |
| HSCOC4_PEA_1_T7 (SEQ ID NO:20) | 566 | 764 |
| HSCOC4_PEA_1_T8 (SEQ ID NO:21) | 566 | 764 |
| HSCOC4_PEA_1_T11 (SEQ ID NO:22) | 566 | 764 |
| HSCOC4_PEA_1_T12 (SEQ ID NO:23) | 566 | 764 |
| HSCOC4_PEA_1_T14 (SEQ ID NO:24) | 566 | 764 |
| HSCOC4_PEA_1_T15 (SEQ ID NO:25) | 566 | 764 |
| HSCOC4_PEA_1_T20 (SEQ ID NO:26) | 566 | 764 |
| HSCOC4_PEA_1_T21 (SEQ ID NO:27) | 566 | 764 |
| HSCOC4_PEA_1_T25 (SEQ ID NO:28) | 566 | 764 |
| HSCOC4_PEA_1_T28 (SEQ ID NO:29) | 566 | 764 |
| HSCOC4_PEA_1_T30 (SEQ ID NO:30) | 566 | 764 |
| HSCOC4_PEA_1_T31 (SEQ ID NO:31) | 566 | 764 |
| HSCOC4_PEA_1_T32 (SEQ ID NO:32) | 566 | 764 |
| HSCOC4_PEA_1_T40 (SEQ ID NO:33) | 566 | 764 |

Segment cluster HSCOC4_PEA_1_node_7 (SEQ ID NO:145) according to the present invention is supported by 35 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO: 19), HSCOC4_PEA_1_T7 (SEQ ID NO:20), HSCOC4_PEA_1_T8 (SEQ ID NO: 21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 207 below describes the starting and ending position of this segment on each transcript.

TABLE 207

Segment location on transcripts

| Transcript name | Segment starting position | Segment ending position |
|---|---|---|
| HSCOC4_PEA_1_T1 (SEQ ID NO:15) | 765 | 885 |
| HSCOC4_PEA_1_T2 (SEQ ID NO:16) | 765 | 885 |

TABLE 207-continued

Segment location on transcripts

| Transcript name | Segment starting position | Segment ending position |
|---|---|---|
| HSCOC4_PEA_1_T3 (SEQ ID NO:17) | 765 | 885 |
| HSCOC4_PEA_1_T4 (SEQ ID NO:18) | 765 | 885 |
| HSCOC4_PEA_1_T5 (SEQ ID NO:19) | 765 | 885 |
| HSCOC4_PEA_1_T7 (SEQ ID NO:20) | 765 | 885 |
| HSCOC4_PEA_1_T8 (SEQ ID NO:21) | 765 | 885 |
| HSCOC4_PEA_1_T11 (SEQ ID NO:22) | 765 | 885 |
| HSCOC4_PEA_1_T12 (SEQ ID NO:23) | 765 | 885 |
| HSCOC4_PEA_1_T14 (SEQ ID NO:24) | 765 | 885 |
| HSCOC4_PEA_1_T15 (SEQ ID NO:25) | 765 | 885 |
| HSCOC4_PEA_1_T20 (SEQ ID NO:26) | 765 | 885 |
| HSCOC4_PEA_1_T21 (SEQ ID NO:27) | 765 | 885 |
| HSCOC4_PEA_1_T25 (SEQ ID NO:28) | 765 | 885 |
| HSCOC4_PEA_1_T28 (SEQ ID NO:29) | 765 | 885 |
| HSCOC4_PEA_1_T30 (SEQ ID NO:30) | 765 | 885 |
| HSCOC4_PEA_1_T31 (SEQ ID NO:31) | 765 | 885 |
| HSCOC4_PEA_1_T32 (SEQ ID NO:32) | 765 | 885 |
| HSCOC4_PEA_1_T40 (SEQ ID NO:33) | 765 | 885 |

Segment cluster HSCOC4_PEA_1_node_30 (SEQ ID NO:146) according to the present invention is supported by 35 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO: 19), HSCOC4_PEA_1_T7 (SEQ ID NO:20), HSCOC4_PEA_1_T8 (SEQ ID NO: 21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 208 below describes the starting and ending position of this segment on each transcript.

TABLE 208

Segment location on transcripts

| Transcript name | Segment starting position | Segment ending position |
|---|---|---|
| HSCOC4_PEA_1_T1 (SEQ ID NO:15) | 1662 | 1841 |
| HSCOC4_PEA_1_T2 (SEQ ID NO:16) | 1662 | 1841 |

TABLE 208-continued

Segment location on transcripts

| Transcript name | Segment starting position | Segment ending position |
|---|---|---|
| HSCOC4_PEA_1_T3 (SEQ ID NO:17) | 1662 | 1841 |
| HSCOC4_PEA_1_T4 (SEQ ID NO:18) | 1662 | 1841 |
| HSCOC4_PEA_1_T5 (SEQ ID NO:19) | 1761 | 1940 |
| HSCOC4_PEA_1_T7 (SEQ ID NO:20) | 1459 | 1638 |
| HSCOC4_PEA_1_T8 (SEQ ID NO:21) | 1662 | 1841 |
| HSCOC4_PEA_1_T11 (SEQ ID NO:22) | 1662 | 1841 |
| HSCOC4_PEA_1_T12 (SEQ ID NO:23) | 1662 | 1841 |
| HSCOC4_PEA_1_T14 (SEQ ID NO:24) | 1662 | 1841 |
| HSCOC4_PEA_1_T15 (SEQ ID NO:25) | 1662 | 1841 |
| HSCOC4_PEA_1_T20 (SEQ ID NO:26) | 1662 | 1841 |
| HSCOC4_PEA_1_T21 (SEQ ID NO:27) | 1662 | 1841 |
| HSCOC4_PEA_1_T25 (SEQ ID NO:28) | 1662 | 1841 |
| HSCOC4_PEA_1_T28 (SEQ ID NO:29) | 1662 | 1841 |
| HSCOC4_PEA_1_T30 (SEQ ID NO:30) | 1662 | 1841 |
| HSCOC4_PEA_1_T31 (SEQ ID NO:31) | 1662 | 1841 |
| HSCOC4_PEA_1_T32 (SEQ ID NO:32) | 1662 | 1841 |
| HSCOC4_PEA_1_T40 (SEQ ID NO:33) | 1662 | 1841 |

Segment cluster HSCOC4_PEA_1_node_33 (SEQ ID NO:147) according to the present invention is supported by 30 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T 11 (SEQ ID NO:22), HSCOC4_PEA_1_T12 (SEQ ID NO:23) HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 209 below describes the starting and ending position of this segment on each transcript.

TABLE 209

Segment location on transcripts

| Transcript name | Segment starting position | Segment ending position |
|---|---|---|
| HSCOC4_PEA_1_T1 (SEQ ID NO:15) | 1842 | 2024 |

TABLE 209-continued

Segment location on transcripts

| Transcript name | Segment starting position | Segment ending position |
|---|---|---|
| HSCOC4_PEA_1_T2 (SEQ ID NO:16) | 1842 | 2024 |
| HSCOC4_PEA_1_T3 (SEQ ID NO:17) | 1842 | 2024 |
| HSCOC4_PEA_1_T4 (SEQ ID NO:18) | 1842 | 2024 |
| HSCOC4_PEA_1_T5 (SEQ ID NO:19) | 1941 | 2123 |
| HSCOC4_PEA_1_T7 (SEQ ID NO:20) | 1639 | 1821 |
| HSCOC4_PEA_1_T8 (SEQ ID NO:21) | 1842 | 2024 |
| HSCOC4_PEA_1_T11 (SEQ ID NO:22) | 1842 | 2024 |
| HSCOC4_PEA_1_T12 (SEQ ID NO:23) | 1842 | 2024 |
| HSCOC4_PEA_1_T14 (SEQ ID NO:24) | 1842 | 2024 |
| HSCOC4_PEA_1_T15 (SEQ ID NO:25) | 1842 | 2024 |
| HSCOC4_PEA_1_T20 (SEQ ID NO:26) | 1842 | 2024 |
| HSCOC4_PEA_1_T21 (SEQ ID NO:27) | 1842 | 2024 |
| HSCOC4_PEA_1_T25 (SEQ ID NO:28) | 1842 | 2024 |
| HSCOC4_PEA_1_T28 (SEQ ID NO:29) | 1842 | 2024 |
| HSCOC4_PEA_1_T30 (SEQ ID NO:30) | 1842 | 2024 |
| HSCOC4_PEA_1_T31 (SEQ ID NO:31) | 1842 | 2024 |
| HSCOC4_PEA_1_T32 (SEQ ID NO:32) | 1842 | 2024 |
| HSCOC4_PEA_1_T40 (SEQ ID NO:33) | 1842 | 2024 |

Segment cluster HSCOC4_PEA_1_node_35 (SEQ ID NO:148) according to the present invention is supported by 31 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T 11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29) HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 210 below describes the starting and ending position of this segment on each transcript.

TABLE 210

Segment location on transcripts

| Transcript name | Segment starting position | Segment ending position |
|---|---|---|
| HSCOC4_PEA_1_T1 (SEQ ID NO:15) | 2025 | 2210 |
| HSCOC4_PEA_1_T2 (SEQ ID NO:16) | 2025 | 2210 |
| HSCOC4_PEA_1_T3 (SEQ ID NO:17) | 2025 | 2210 |
| HSCOC4_PEA_1_T4 (SEQ ID NO:18) | 2025 | 2210 |
| HSCOC4_PEA_1_T5 (SEQ ID NO:19) | 2124 | 2309 |
| HSCOC4_PEA_1_T7 (SEQ ID NO:20) | 1822 | 2007 |
| HSCOC4_PEA_1_T8 (SEQ ID NO:21) | 2025 | 2210 |
| HSCOC4_PEA_1_T11 (SEQ ID NO:22) | 2025 | 2210 |
| HSCOC4_PEA_1_T12 (SEQ ID NO:23) | 2025 | 2210 |
| HSCOC4_PEA_1_T14 (SEQ ID NO:24) | 2025 | 2210 |
| HSCOC4_PEA_1_T15 (SEQ ID NO:25) | 2025 | 2210 |
| HSCOC4_PEA_1_T20 (SEQ ID NO:26) | 2025 | 2210 |
| HSCOC4_PEA_1_T21 (SEQ ID NO:27) | 2025 | 2210 |
| HSCOC4_PEA_1_T25 (SEQ ID NO:28) | 2025 | 2210 |
| HSCOC4_PEA_1_T28 (SEQ ID NO:29) | 2025 | 2210 |
| HSCOC4_PEA_1_T30 (SEQ ID NO:30) | 2025 | 2210 |
| HSCOC4_PEA_1_T31 (SEQ ID NO:31) | 2025 | 2210 |
| HSCOC4_PEA_1_T32 (SEQ ID NO:32) | 2025 | 2210 |
| HSCOC4_PEA_1_T40 (SEQ ID NO:33) | 2025 | 2210 |

Segment cluster HSCOC4_PEA_1_node_37 (SEQ ID NO:149) according to the present invention is supported by 33 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T 11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) HSCOC4_PEA_1_T32 (SEQ ID NO:32) and HSCOC4_PEA_1_T40 (SEQ ID NO:33). Table 211 below describes the starting and ending position of this segment on each transcript.

TABLE 211

Segment location on transcripts

| Transcript name | Segment starting position | Segment ending position |
|---|---|---|
| HSCOC4_PEA_1_T1 (SEQ ID NO:15) | 2211 | 2369 |
| HSCOC4_PEA_1_T2 (SEQ ID NO:16) | 2211 | 2369 |
| HSCOC4_PEA_1_T3 (SEQ ID NO:17) | 2211 | 2369 |
| HSCOC4_PEA_1_T4 (SEQ ID NO:18) | 2211 | 2369 |
| HSCOC4_PEA_1_T5 (SEQ ID NO:19) | 2310 | 2468 |
| HSCOC4_PEA_1_T7 (SEQ ID NO:20) | 2008 | 2166 |
| HSCOC4_PEA_1_T8 (SEQ ID NO:21) | 2211 | 2369 |
| HSCOC4_PEA_1_T11 (SEQ ID NO:22) | 2211 | 2369 |
| HSCOC4_PEA_1_T12 (SEQ ID NO:23) | 2211 | 2369 |
| HSCOC4_PEA_1_T14 (SEQ ID NO:24) | 2211 | 2369 |
| HSCOC4_PEA_1_T15 (SEQ ID NO:25) | 2211 | 2369 |
| HSCOC4_PEA_1_T20 (SEQ ID NO:26) | 2211 | 2369 |
| HSCOC4_PEA_1_T21 (SEQ ID NO:27) | 2211 | 2369 |
| HSCOC4_PEA_1_T25 (SEQ ID NO:28) | 2211 | 2369 |
| HSCOC4_PEA_1_T28 (SEQ ID NO:29) | 2211 | 2369 |
| HSCOC4_PEA_1_T30 (SEQ ID NO:30) | 2211 | 2369 |
| HSCOC4_PEA_1_T31 (SEQ ID NO:31) | 2211 | 2369 |
| HSCOC4_PEA_1_T32 (SEQ ID NO:32) | 2211 | 2369 |
| HSCOC4_PEA_1_T40 (SEQ ID NO:33) | 2211 | 2369 |

Segment cluster HSCOC4_PEA_1_node_39 (SEQ ID NO:150) according to the present invention is supported by 35 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19) HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 212 below describes the starting and ending position of this segment on each transcript.

TABLE 212

Segment location on transcripts

| Transcript name | Segment starting position | Segment ending position |
|---|---|---|
| HSCOC4_PEA_1_T1 (SEQ ID NO:15) | 2370 | 2496 |
| HSCOC4_PEA_1_T2 (SEQ ID NO:16) | 2370 | 2496 |
| HSCOC4_PEA_1_T3 (SEQ ID NO:17) | 2370 | 2496 |
| HSCOC4_PEA_1_T4 (SEQ ID NO:18) | 2370 | 2496 |
| HSCOC4_PEA_1_T5 (SEQ ID NO:19) | 2469 | 2595 |
| HSCOC4_PEA_1_T7 (SEQ ID NO:20) | 2167 | 2293 |
| HSCOC4_PEA_1_T8 (SEQ ID NO:21) | 2370 | 2496 |
| HSCOC4_PEA_1_T11 (SEQ ID NO:22) | 2370 | 2496 |
| HSCOC4_PEA_1_T12 (SEQ ID NO:23) | 2370 | 2496 |
| HSCOC4_PEA_1_T14 (SEQ ID NO:24) | 2370 | 2496 |
| HSCOC4_PEA_1_T15 (SEQ ID NO:25) | 2370 | 2496 |
| HSCOC4_PEA_1_T20 (SEQ ID NO:26) | 2370 | 2496 |
| HSCOC4_PEA_1_T21 (SEQ ID NO:27) | 2370 | 2496 |
| HSCOC4_PEA_1_T25 (SEQ ID NO:28) | 2370 | 2496 |
| HSCOC4_PEA_1_T28 (SEQ ID NO:29) | 2370 | 2496 |
| HSCOC4_PEA_1_T30 (SEQ ID NO:30) | 2370 | 2496 |
| HSCOC4_PEA_1_T31 (SEQ ID NO:31) | 2370 | 2496 |
| HSCOC4_PEA_1_T32 (SEQ ID NO:32) | 2370 | 2496 |
| HSCOC4_PEA_1_T40 (SEQ ID NO:33) | 2370 | 2496 |

Segment cluster HSCOC4_PEA_1_node_43 (SEQ ID NO:151) according to the present invention is supported by 34 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23) HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4 PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 213 below describes the starting and ending position of this segment on each transcript.

TABLE 213

Segment location on transcripts

| Transcript name | Segment starting position | Segment ending position |
|---|---|---|
| HSCOC4_PEA_1_T1 (SEQ ID NO:15) | 2572 | 2769 |
| HSCOC4_PEA_1_T2 (SEQ ID NO:16) | 2572 | 2769 |
| HSCOC4_PEA_1_T3 (SEQ ID NO:17) | 2572 | 2769 |
| HSCOC4_PEA_1_T4 (SEQ ID NO:18) | 2572 | 2769 |
| HSCOC4_PEA_1_T5 (SEQ ID NO:19) | 2671 | 2868 |
| HSCOC4_PEA_1_T7 (SEQ ID NO:20) | 2369 | 2566 |
| HSCOC4_PEA_1_T8 (SEQ ID NO:21) | 2572 | 2769 |
| HSCOC4_PEA_1_T11 (SEQ ID NO:22) | 2572 | 2769 |
| HSCOC4_PEA_1_T12 (SEQ ID NO:23) | 2572 | 2769 |
| HSCOC4_PEA_1_T14 (SEQ ID NO:24) | 2572 | 2769 |
| HSCOC4_PEA_1_T15 (SEQ ID NO:25) | 2572 | 2769 |
| HSCOC4_PEA_1_T20 (SEQ ID NO:26) | 2572 | 2769 |
| HSCOC4_PEA_1_T21 (SEQ ID NO:27) | 2572 | 2769 |
| HSCOC4_PEA_1_T25 (SEQ ID NO:28) | 2572 | 2769 |
| HSCOC4_PEA_1_T28 (SEQ ID NO:29) | 2572 | 2769 |
| HSCOC4_PEA_1_T30 (SEQ ID NO:30) | 2572 | 2769 |
| HSCOC4_PEA_1_T31 (SEQ ID NO:31) | 2572 | 2769 |
| HSCOC4_PEA_1_T32 (SEQ ID NO:32) | 2572 | 2769 |
| HSCOC4_PEA_1_T40 (SEQ ID NO:33) | 2572 | 2769 |

Segment cluster HSCOC4_PEA_1_node_48 (SEQ ID NO:152) according to the present invention is supported by 2 libraries. The number of libraries was determined as previously described. This segment can be found in the following transcript(s): HSCOC4_PEA_1_T2 (SEQ ID NO:16) and HSCOC4_PEA_1_T3 (SEQ ID NO:17). Table 214 below describes the starting and ending position of this segment on each transcript.

TABLE 214

Segment location on transcripts

| Transcript name | Segment starting position | Segment ending position |
|---|---|---|
| HSCOC4_PEA_1_T2 (SEQ ID NO:16) | 2953 | 3210 |
| HSCOC4_PEA_1_T3 (SEQ ID NO:17) | 2953 | 3210 |

Segment cluster HSCOC4_PEA_1_node_49 (SEQ ID NO:153) according to the present invention is supported by 37 libraries. The number of libraries was determined as previously described. This segment can be found in the following transcript(s): HSCOC4_PEA_1_T1 (SEQ ID NO:151, HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 215 below describes the starting and ending position of this segment on each transcript.

TABLE 215

Segment location on transcripts

| Transcript name | Segment starting position | Segment ending position |
|---|---|---|
| HSCOC4_PEA_1_T1 (SEQ ID NO:15) | 2953 | 3092 |
| HSCOC4_PEA_1_T2 (SEQ ID NO:16) | 3211 | 3350 |
| HSCOC4_PEA_1_T3 (SEQ ID NO:17) | 3211 | 3350 |
| HSCOC4_PEA_1_T4 (SEQ ID NO:18) | 2953 | 3092 |
| HSCOC4_PEA_1_T5 (SEQ ID NO:19) | 3052 | 3191 |
| HSCOC4_PEA_1_T7 (SEQ ID NO:20) | 2750 | 2889 |
| HSCOC4_PEA_1_T8 (SEQ ID NO:21) | 2953 | 3092 |
| HSCOC4_PEA_1_T11 (SEQ ID NO:22) | 2953 | 3092 |
| HSCOC4_PEA_1_T12 (SEQ ID NO:23) | 2953 | 3092 |
| HSCOC4_PEA_1_T14 (SEQ ID NO:24) | 2953 | 3092 |
| HSCOC4_PEA_1_T15 (SEQ ID NO:25) | 2953 | 3092 |
| HSCOC4_PEA_1_T20 (SEQ ID NO:26) | 2953 | 3092 |
| HSCOC4_PEA_1_T21 (SEQ ID NO:27) | 2953 | 3092 |
| HSCOC4_PEA_1_T25 (SEQ ID NO:28) | 2953 | 3092 |
| HSCOC4_PEA_1_T28 (SEQ ID NO:29) | 2953 | 3092 |
| HSCOC4_PEA_1_T30 (SEQ ID NO:30) | 2953 | 3092 |
| HSCOC4_PEA_1_T31 (SEQ ID NO:31) | 2953 | 3092 |
| HSCOC4_PEA_1_T32 (SEQ ID NO:32) | 2953 | 3092 |
| HSCOC4_PEA_1_T40 (SEQ ID NO:33) | 2953 | 3092 |

Segment cluster HSCOC4_PEA_1_node_51 (SEQ ID NO:154) according to the present invention is supported by 40 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA 11T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 216 below describes the starting and ending position of this segment on each transcript.

TABLE 216

Segment location on transcripts

| Transcript name | Segment starting position | Segment ending position |
| --- | --- | --- |
| HSCOC4_PEA_1_T1 (SEQ ID NO:15) | 3206 | 3415 |
| HSCOC4_PEA_1_T2 (SEQ ID NO:16) | 3351 | 3560 |
| HSCOC4_PEA_1_T3 (SEQ ID NO:17) | 3464 | 3673 |
| HSCOC4_PEA_1_T4 (SEQ ID NO:18) | 3093 | 3302 |
| HSCOC4_PEA_1_T5 (SEQ ID NO:19) | 3192 | 3401 |
| HSCOC4_PEA_1_T7 (SEQ ID NO:20) | 2890 | 3099 |
| HSCOC4_PEA_1_T8 (SEQ ID NO:21) | 3093 | 3302 |
| HSCOC4_PEA_1_T11 (SEQ ID NO:22) | 3093 | 3302 |
| HSCOC4_PEA_1_T12 (SEQ ID NO:23) | 3093 | 3302 |
| HSCOC4_PEA_1_T14 (SEQ ID NO:24) | 3093 | 3302 |
| HSCOC4_PEA_1_T15 (SEQ ID NO:25) | 3093 | 3302 |
| HSCOC4_PEA_1_T20 (SEQ ID NO:26) | 3093 | 3302 |
| HSCOC4_PEA_1_T21 (SEQ ID NO:27) | 3093 | 3302 |
| HSCOC4_PEA_1_T25 (SEQ ID NO:28) | 3093 | 3302 |
| HSCOC4_PEA_1_T28 (SEQ ID NO:29) | 3093 | 3302 |
| HSCOC4_PEA_1_T30 (SEQ ID NO:30) | 3093 | 3302 |
| HSCOC4_PEA_1_T31 (SEQ ID NO:31) | 3093 | 3302 |
| HSCOC4_PEA_1_T32 (SEQ ID NO:32) | 3093 | 3302 |
| HSCOC4_PEA_1_T40 (SEQ ID NO:33) | 3093 | 3302 |

Segment cluster HSCOC4_PEA_1_node_58 (SEQ ID NO:155) according to the present invention is supported by 52 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 217 below describes the starting and ending position of this segment on each transcript.

TABLE 217

Segment location on transcripts

| Transcript name | Segment starting position | Segment ending position |
| --- | --- | --- |
| HSCOC4_PEA_1_T1 (SEQ ID NO:15) | 3605 | 3767 |
| HSCOC4_PEA_1_T2 (SEQ ID NO:16) | 3750 | 3912 |
| HSCOC4_PEA_1_T3 (SEQ ID NO:17) | 3863 | 4025 |
| HSCOC4_PEA_1_T4 (SEQ ID NO:18) | 3492 | 3654 |
| HSCOC4_PEA_1_T5 (SEQ ID NO:19) | 3591 | 3753 |
| HSCOC4_PEA_1_T7 (SEQ ID NO:20) | 3289 | 3451 |
| HSCOC4_PEA_1_T8 (SEQ ID NO:21) | 3492 | 3654 |
| HSCOC4_PEA_1_T11 (SEQ ID NO:22) | 3492 | 3654 |
| HSCOC4_PEA_1_T12 (SEQ ID NO:23) | 3492 | 3654 |
| HSCOC4_PEA_1_T14 (SEQ ID NO:24) | 3492 | 3654 |
| HSCOC4_PEA_1_T15 (SEQ ID NO:25) | 3492 | 3654 |
| HSCOC4_PEA_1_T20 (SEQ ID NO:26) | 3492 | 3654 |
| HSCOC4_PEA_1_T21 (SEQ ID NO:27) | 3492 | 3654 |
| HSCOC4_PEA_1_T25 (SEQ ID NO:28) | 3492 | 3654 |
| HSCOC4_PEA_1_T28 (SEQ ID NO:29) | 3492 | 3654 |
| HSCOC4_PEA_1_T30 (SEQ ID NO:30) | 3492 | 3654 |
| HSCOC4_PEA_1_T31 (SEQ ID NO:31) | 3492 | 3654 |
| HSCOC4_PEA_1_T32 (SEQ ID NO:32) | 3492 | 3654 |
| HSCOC4_PEA_1_T40 (SEQ ID NO:33) | 3492 | 3654 |

Segment cluster HSCOC4_PEA_1_node_59 (SEQ ID NO:156) according to the present invention is supported by 8 libraries. The number of libraries was determined as previously described. This segment can be found in the following transcript(s): HSCOC4_PEA_1_T4 (SEQ ID NO:18). Table 218 below describes the starting and ending position of this segment on each transcript.

TABLE 218

Segment location on transcripts

| Transcript name | Segment starting position | Segment ending position |
| --- | --- | --- |
| HSCOC4_PEA_1_T4 (SEQ ID NO:18) | 3655 | 3833 |

Segment cluster HSCOC4_PEA_1_node_62 (SEQ ID NO:157) according to the present invention is supported by 61 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 219 below describes the starting and ending position of this segment on each transcript.

TABLE 219

Segment location on transcripts

| Transcript name | Segment starting position | Segment ending position |
| --- | --- | --- |
| HSCOC4_PEA_1_T1 (SEQ ID NO:15) | 3844 | 4000 |
| HSCOC4_PEA_1_T2 (SEQ ID NO:16) | 3989 | 4145 |
| HSCOC4_PEA_1_T3 (SEQ ID NO:17) | 4102 | 4258 |
| HSCOC4_PEA_1_T4 (SEQ ID NO:18) | 3910 | 4066 |
| HSCOC4_PEA_1_T5 (SEQ ID NO:19) | 3830 | 3986 |
| HSCOC4_PEA_1_T7 (SEQ ID NO:20) | 3528 | 3684 |
| HSCOC4_PEA_1_T8 (SEQ ID NO:21) | 3731 | 3887 |
| HSCOC4_PEA_1_T11 (SEQ ID NO:22) | 3731 | 3887 |
| HSCOC4_PEA_1_T12 (SEQ ID NO:23) | 3731 | 3887 |
| HSCOC4_PEA_1_T14 (SEQ ID NO:24) | 3731 | 3887 |
| HSCOC4_PEA_1_T15 (SEQ ID NO:25) | 3731 | 3887 |
| HSCOC4_PEA_1_T20 (SEQ ID NO:26) | 3731 | 3887 |
| HSCOC4_PEA_1_T21 (SEQ ID NO:27) | 3731 | 3887 |
| HSCOC4_PEA_1_T25 (SEQ ID NO:28) | 3731 | 3887 |
| HSCOC4_PEA_1_T28 (SEQ ID NO:29) | 3731 | 3887 |
| HSCOC4_PEA_1_T30 (SEQ ID NO:30) | 3731 | 3887 |
| HSCOC4_PEA_1_T31 (SEQ ID NO:31) | 3731 | 3887 |
| HSCOC4_PEA_1_T32 (SEQ ID NO:32) | 3731 | 3887 |
| HSCOC4_PEA_1_T40 (SEQ ID NO:33) | 3731 | 3887 |

Segment cluster HSCOC4_PEA_1_node_66 (SEQ ID NO:158) according to the present invention is supported by 65 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 220 below describes the starting and ending position of this segment on each transcript.

TABLE 220

Segment location on transcripts

| Transcript name | Segment starting position | Segment ending position |
| --- | --- | --- |
| HSCOC4_PEA_1_T1 (SEQ ID NO:15) | 4118 | 4289 |
| HSCOC4_PEA_1_T2 (SEQ ID NO:16) | 4263 | 4434 |
| HSCOC4_PEA_1_T3 (SEQ ID NO:17) | 4376 | 4547 |
| HSCOC4_PEA_1_T4 (SEQ ID NO:18) | 4184 | 4355 |
| HSCOC4_PEA_1_T5 (SEQ ID NO:19) | 4104 | 4275 |
| HSCOC4_PEA_1_T7 (SEQ ID NO:20) | 3802 | 3973 |
| HSCOC4_PEA_1_T8 (SEQ ID NO:21) | 4005 | 4176 |
| HSCOC4_PEA_1_T11 (SEQ ID NO:22) | 4005 | 4176 |
| HSCOC4_PEA_1_T12 (SEQ ID NO:23) | 4005 | 4176 |
| HSCOC4_PEA_1_T14 (SEQ ID NO:24) | 4005 | 4176 |
| HSCOC4_PEA_1_T15 (SEQ ID NO:25) | 4005 | 4176 |
| HSCOC4_PEA_1_T20 (SEQ ID NO:26) | 4005 | 4176 |
| HSCOC4_PEA_1_T21 (SEQ ID NO:27) | 4005 | 4176 |
| HSCOC4_PEA_1_T25 (SEQ ID NO:28) | 4005 | 4176 |
| HSCOC4_PEA_1_T28 (SEQ ID NO:29) | 4005 | 4176 |
| HSCOC4_PEA_1_T30 (SEQ ID NO:30) | 4005 | 4176 |
| HSCOC4_PEA_1_T31 (SEQ ID NO:31) | 4005 | 4176 |
| HSCOC4_PEA_1_T32 (SEQ ID NO:32) | 4005 | 4176 |
| HSCOC4_PEA_1_T40 (SEQ ID NO:33) | 4005 | 4176 |

Segment cluster HSCOC4_PEA_1_node_72 (SEQ ID NO:159) according to the present invention is supported by 65 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA_1_T32 (SEQ ID NO:32). Table 221 below describes the starting and ending position of this segment on each transcript.

TABLE 221

Segment location on transcripts

| Transcript name | Segment starting position | Segment ending position |
| --- | --- | --- |
| HSCOC4_PEA_1_T1 (SEQ ID NO:15) | 4392 | 4522 |
| HSCOC4_PEA_1_T2 (SEQ ID NO:16) | 4537 | 4667 |
| HSCOC4_PEA_1_T3 (SEQ ID NO:17) | 4650 | 4780 |
| HSCOC4_PEA_1_T4 (SEQ ID NO:18) | 4458 | 4588 |
| HSCOC4_PEA_1_T5 (SEQ ID NO:19) | 4378 | 4508 |
| HSCOC4_PEA_1_T7 (SEQ ID NO:20) | 4076 | 4206 |
| HSCOC4_PEA_1_T8 (SEQ ID NO:21) | 4279 | 4409 |
| HSCOC4_PEA_1_T11 (SEQ ID NO:22) | 4279 | 4409 |
| HSCOC4_PEA_1_T12 (SEQ ID NO:23) | 4279 | 4409 |
| HSCOC4_PEA_1_T14 (SEQ ID NO:24) | 4279 | 4409 |
| HSCOC4_PEA_1_T15 (SEQ ID NO:25) | 4279 | 4409 |
| HSCOC4_PEA_1_T20 (SEQ ID NO:26) | 4279 | 4409 |
| HSCOC4_PEA_1_T21 (SEQ ID NO:27) | 4279 | 4409 |
| HSCOC4_PEA_1_T25 (SEQ ID NO:28) | 4279 | 4409 |
| HSCOC4_PEA_1_T28 (SEQ ID NO:29) | 4279 | 4409 |
| HSCOC4_PEA_1_T30 (SEQ ID NO:30) | 4279 | 4409 |
| HSCOC4_PEA_1_T31 (SEQ ID NO:31) | 4279 | 4409 |
| HSCOC4_PEA_1_T32 (SEQ ID NO:32) | 4279 | 4409 |

Segment cluster HSCOC4_PEA_1_node_77 (SEQ ID NO:160) according to the present invention is supported by 2 libraries. The number of libraries was determined as previously described. This segment can be found in the following transcript(s): HSCOC4_PEA_1_T14 (SEQ ID NO:24) and HSCOC4_PEA_1_T20 (SEQ ID NO:26). Table 222 below describes the starting and ending position of this segment on each transcript.

TABLE 222

Segment location on transcripts

| Transcript name | Segment starting position | Segment ending position |
| --- | --- | --- |
| HSCOC4_PEA_1_T14 (SEQ ID NO:24) | 4578 | 4970 |
| HSCOC4_PEA_1_T20 (SEQ ID NO:26) | 4660 | 5052 |

Segment cluster HSCOC4_PEA_1_node_79 (SEQ ID NO:161) according to the present invention is supported by 6 libraries. The number of libraries was determined as previously described. This segment can be found in the following transcript(s): HSCOC4_PEA_1_T11 (SEQ ID NO:22). Table 223 below describes the starting and ending position of this segment on each transcript.

TABLE 223

Segment location on transcripts

| Transcript name | Segment starting position | Segment ending position |
| --- | --- | --- |
| HSCOC4_PEA_1_T11 (SEQ ID NO:22) | 4638 | 5686 |

Segment cluster HSCOC4_PEA_1_node_93 (SEQ ID NO:162) according to the present invention is supported by 25 libraries. The number of libraries was determined as previously described. This segment can be found in the following transcript(s): HSCOC4_PEA_1_T8 (SEQ ID NO:21), HSCOC4_PEA_1_T12 (SEQ ID NO:23) and HSCOC4_PEA_1_T21 (SEQ ID NO:27). Table 224 below describes the starting and ending position of this segment on each transcript.

TABLE 224

Segment location on transcripts

| Transcript name | Segment starting position | Segment ending position |
| --- | --- | --- |
| HSCOC4_PEA_1_T8 (SEQ ID NO:21) | 5085 | 6566 |
| HSCOC4_PEA_1_T12 (SEQ ID NO:23) | 5289 | 6770 |
| HSCOC4_PEA_1_T21 (SEQ ID NO:27) | 5085 | 6566 |

Segment cluster HSCOC4_PEA_1_node_100 (SEQ ID NO:163) according to the present invention is supported by 13 libraries. The number of libraries was determined as previously described. This segment can be found in the following transcript(s): HSCOC4_PEA_1_T21 (SEQ ID NO:27). Table 225 below describes the starting and ending position of this segment on each transcript.

TABLE 225

Segment location on transcripts

| Transcript name | Segment starting position | Segment ending position |
| --- | --- | --- |
| HSCOC4_PEA_1_T21 (SEQ ID NO:27) | 6679 | 6843 |

Segment cluster HSCOC4_PEA_1_node_105 (SEQ ID NO:164) according to the present invention is supported by 9 libraries. The number of libraries was determined as previously described. This segment can be found in the following transcript(s): HSCOC4_PEA_1_T28 (SEQ ID NO:29) and HSCOC4_PEA_1_T32 (SEQ ID NO:32). Table 226 below describes the starting and ending position of this segment on each transcript.

TABLE 226

Segment location on transcripts

| Transcript name | Segment starting position | Segment ending position |
| --- | --- | --- |
| HSCOC4_PEA_1_T28 (SEQ ID NO:29) | 5377 | 5558 |
| HSCOC4_PEA_1_T32 (SEQ ID NO:32) | 5462 | 5643 |

Segment cluster HSCOC4_PEA_1_node_107 (SEQ ID NO:165) according to the present invention is supported by 27 libraries. The number of libraries was determined as previously described. This segment can be found in the following transcript(s): HSCOC4_PEA_1_T25 (SEQ ID NO:28), HSCOC4_PEA_1_T28 (SEQ ID NO:29) and HSCOC4_PEA_1_T32 (SEQ ID NO:32). Table 227 below describes the starting and ending position of this segment on each transcript.

TABLE 227

Segment location on transcripts

| Transcript name | Segment starting position | Segment ending position |
|---|---|---|
| HSCOC4_PEA_1_T25 (SEQ ID NO:28) | 5461 | 5722 |
| HSCOC4_PEA_1_T28 (SEQ ID NO:29) | 5643 | 5904 |
| HSCOC4_PEA_1_T32 (SEQ ID NO:32) | 5728 | 5989 |

Segment cluster HSCOC4_PEA_1_node_108 (SEQ ID NO:166) according to the present invention is supported by 120 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 228 below describes the starting and ending position of this segment on each transcript.

TABLE 228

Segment location on transcripts

| Transcript name | Segment starting position | Segment ending position |
|---|---|---|
| HSCOC4_PEA_1_T1 (SEQ ID NO:15) | 5574 | 5706 |
| HSCOC4_PEA_1_T2 (SEQ ID NO:16) | 5719 | 5851 |
| HSCOC4_PEA_1_T3 (SEQ ID NO:17) | 5832 | 5964 |
| HSCOC4_PEA_1_T4 (SEQ ID NO:18) | 5640 | 5772 |
| HSCOC4_PEA_1_T5 (SEQ ID NO:19) | 5560 | 5692 |
| HSCOC4_PEA_1_T7 (SEQ ID NO:20) | 5258 | 5390 |
| HSCOC4_PEA_1_T8 (SEQ ID NO:21) | 6952 | 7084 |
| HSCOC4_PEA_1_T11 (SEQ ID NO:22) | 6510 | 6642 |
| HSCOC4_PEA_1_T12 (SEQ ID NO:23) | 7156 | 7288 |
| HSCOC4_PEA_1_T14 (SEQ ID NO:24) | 5854 | 5986 |

TABLE 228-continued

Segment location on transcripts

| Transcript name | Segment starting position | Segment ending position |
|---|---|---|
| HSCOC4_PEA_1_T15 (SEQ ID NO:25) | 5414 | 5546 |
| HSCOC4_PEA_1_T20 (SEQ ID NO:26) | 5936 | 6068 |
| HSCOC4_PEA_1_T21 (SEQ ID NO:27) | 7117 | 7249 |
| HSCOC4_PEA_1_T25 (SEQ ID NO:28) | 5723 | 5855 |
| HSCOC4_PEA_1_T28 (SEQ ID NO:29) | 5905 | 6037 |
| HSCOC4_PEA_1_T30 (SEQ ID NO:30) | 5358 | 5490 |
| HSCOC4_PEA_1_T31 (SEQ ID NO:31) | 5546 | 5678 |
| HSCOC4_PEA_1_T32 (SEQ ID NO:32) | 5990 | 6122 |
| HSCOC4_PEA_1_T40 (SEQ ID NO:33) | 4499 | 4631 |

Segment cluster HSCOC4_PEA_1_node_109 (SEQ ID NO:167) according to the present invention is supported by 12 libraries. The number of libraries was determined as previously described. This segment can be found in the following transcript(s): HSCOC4_PEA_1_T25 (SEQ ID NO:28) and HSCOC4_PEA_1_T28 (SEQ ID NO:29). Table 229 below describes the starting and ending position of this segment on each transcript.

TABLE 229

Segment location on transcripts

| Transcript name | Segment starting position | Segment ending position |
|---|---|---|
| HSCOC4_PEA_1_T25 (SEQ ID NO:28) | 5856 | 5998 |
| HSCOC4_PEA_1_T28 (SEQ ID NO:29) | 6038 | 6180 |

Segment cluster HSCOC4_PEA_1_node_110 (SEQ ID NO:168) according to the present invention is supported by 97 libraries. The number of libraries was determined as previously described. This segment can be found in the following transcript(s): HSCOC4_PEA_1_T1 (SEQ ID NO:15, HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 230 below describes the starting and ending position of this segment on each transcript.

TABLE 230

Segment location on transcripts

| Transcript name | Segment starting position | Segment ending position |
|---|---|---|
| HSCOC4_PEA_1_T1 (SEQ ID NO:15) | 5707 | 5856 |
| HSCOC4_PEA_1_T2 (SEQ ID NO:16) | 5852 | 6001 |
| HSCOC4_PEA_1_T3 (SEQ ID NO:17) | 5965 | 6114 |
| HSCOC4_PEA_1_T4 (SEQ ID NO:18) | 5773 | 5922 |
| HSCOC4_PEA_1_T5 (SEQ ID NO:19) | 5693 | 5842 |
| HSCOC4_PEA_1_T7 (SEQ ID NO:20) | 5391 | 5540 |
| HSCOC4_PEA_1_T8 (SEQ ID NO:21) | 7085 | 7234 |
| HSCOC4_PEA_1_T11 (SEQ ID NO:22) | 6643 | 6792 |
| HSCOC4_PEA_1_T12 (SEQ ID NO:23) | 7289 | 7438 |
| HSCOC4_PEA_1_T14 (SEQ ID NO:24) | 5987 | 6136 |
| HSCOC4_PEA_1_T15 (SEQ ID NO:25) | 5547 | 5696 |
| HSCOC4_PEA_1_T20 (SEQ ID NO:26) | 6069 | 6218 |
| HSCOC4_PEA_1_T21 (SEQ ID NO:27) | 7250 | 7399 |
| HSCOC4_PEA_1_T25 (SEQ ID NO:28) | 5999 | 6148 |
| HSCOC4_PEA_1_T28 (SEQ ID NO:29) | 6181 | 6330 |
| HSCOC4_PEA_1_T30 (SEQ ID NO:30) | 5491 | 5640 |
| HSCOC4_PEA_1_T31 (SEQ ID NO:31) | 5679 | 5828 |
| HSCOC4_PEA_1_T32 (SEQ ID NO:32) | 6123 | 6272 |
| HSCOC4_PEA_1_T40 (SEQ ID NO:33) | 4632 | 4781 |

Segment cluster HSCOC4_PEA_1_node_112 (SEQ ID NO:169) according to the present invention is supported by 71 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 231 below describes the starting and ending position of this segment on each transcript.

TABLE 231

Segment location on transcripts

| Transcript name | Segment starting position | Segment ending position |
|---|---|---|
| HSCOC4_PEA_1_T1 (SEQ ID NO:15) | 5948 | 5989 |
| HSCOC4_PEA_1_T2 (SEQ ID NO:16) | 6093 | 6134 |
| HSCOC4_PEA_1_T3 (SEQ ID NO:17) | 6206 | 6247 |
| HSCOC4_PEA_1_T4 (SEQ ID NO:18) | 6014 | 6055 |
| HSCOC4_PEA_1_T5 (SEQ ID NO:19) | 5934 | 5975 |
| HSCOC4_PEA_1_T7 (SEQ ID NO:20) | 5632 | 5673 |
| HSCOC4_PEA_1_T8 (SEQ ID NO:21) | 7326 | 7367 |
| HSCOC4_PEA_1_T11 (SEQ ID NO:22) | 6884 | 6925 |
| HSCOC4_PEA_1_T12 (SEQ ID NO:23) | 7530 | 7571 |
| HSCOC4_PEA_1_T14 (SEQ ID NO:24) | 6228 | 6269 |
| HSCOC4_PEA_1_T15 (SEQ ID NO:25) | 5788 | 5829 |
| HSCOC4_PEA_1_T20 (SEQ ID NO:26) | 6310 | 6351 |
| HSCOC4_PEA_1_T21 (SEQ ID NO:27) | 7491 | 7532 |
| HSCOC4_PEA_1_T25 (SEQ ID NO:28) | 6240 | 6619 |
| HSCOC4_PEA_1_T28 (SEQ ID NO:29) | 6422 | 6801 |
| HSCOC4_PEA_1_T30 (SEQ ID NO:30) | 5732 | 5773 |
| HSCOC4_PEA_1_T31 (SEQ ID NO:31) | 5920 | 5961 |
| HSCOC4_PEA_1_T32 (SEQ ID NO:32) | 6364 | 6743 |
| HSCOC4_PEA_1_T40 (SEQ ID NO:33) | 4873 | 4914 |

Segment cluster HSCOC4_PEA_1_node_113 (SEQ ID NO:170) according to the present invention is supported by 19 libraries. The number of libraries was determined as previously described. This segment can be found in the following transcript(s): HSCOC4_PEA_1_T25 (SEQ ID NO:28), HSCOC4_PEA_1_T28 (SEQ ID NO:29) and HSCOC4_PEA_1_T32 (SEQ ID NO:32). Table 232 below describes the starting and ending position of this segment on each transcript.

TABLE 232

Segment location on transcripts

| Transcript name | Segment starting position | Segment ending position |
|---|---|---|
| HSCOC4_PEA_1_T25 (SEQ ID NO:28) | 6620 | 7765 |
| HSCOC4_PEA_1_T28 (SEQ ID NO:29) | 6802 | 7947 |
| HSCOC4_PEA_1_T32 (SEQ ID NO:32) | 6744 | 7889 |

According to an optional embodiment of the present invention, short segments related to the above cluster are also provided. These segments are up to about 120 bp in length, and so are included in a separate description.

Segment cluster HSCOC4_PEA_1_node_2 (SEQ ID NO:171) according to the present invention is supported by 25 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 233 below describes the starting and ending position of this segment on each transcript.

TABLE 233

Segment location on transcripts

| Transcript name | Segment starting position | Segment ending position |
|---|---|---|
| HSCOC4_PEA_1_T1 (SEQ ID NO:15) | 536 | 565 |
| HSCOC4_PEA_1_T2 (SEQ ID NO:16) | 536 | 565 |
| HSCOC4_PEA_1_T3 (SEQ ID NO:17) | 536 | 565 |
| HSCOC4_PEA_1_T4 (SEQ ID NO:18) | 536 | 565 |
| HSCOC4_PEA_1_T5 (SEQ ID NO:19) | 536 | 565 |
| HSCOC4_PEA_1_T7 (SEQ ID NO:20) | 536 | 565 |
| HSCOC4_PEA_1_T8 (SEQ ID NO:21) | 536 | 565 |
| HSCOC4_PEA_1_T11 (SEQ ID NO:22) | 536 | 565 |
| HSCOC4_PEA_1_T12 (SEQ ID NO:23) | 536 | 565 |
| HSCOC4_PEA_1_T14 (SEQ ID NO:24) | 536 | 565 |
| HSCOC4_PEA_1_T15 (SEQ ID NO:25) | 536 | 565 |
| HSCOC4_PEA_1_T20 (SEQ ID NO:26) | 536 | 565 |
| HSCOC4_PEA_1_T21 (SEQ ID NO:27) | 536 | 565 |
| HSCOC4_PEA_1_T25 (SEQ ID NO:28) | 536 | 565 |
| HSCOC4_PEA_1_T28 (SEQ ID NO:29) | 536 | 565 |
| HSCOC4_PEA_1_T30 (SEQ ID NO:30) | 536 | 565 |
| HSCOC4_PEA_1_T31 (SEQ ID NO:31) | 536 | 565 |
| HSCOC4_PEA_1_T32 (SEQ ID NO:32) | 536 | 565 |
| HSCOC4_PEA_1_T40 (SEQ ID NO:33) | 536 | 565 |

Segment cluster HSCOC4_PEA_1_node_8 (SEQ ID NO:172) according to the present invention is supported by 35 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 234 below describes the starting and ending position of this segment on each transcript.

TABLE 234

Segment location on transcripts

| Transcript name | Segment starting position | Segment ending position |
|---|---|---|
| HSCOC4_PEA_1_T1 (SEQ ID NO:15) | 886 | 966 |
| HSCOC4_PEA_1_T2 (SEQ ID NO:16) | 886 | 966 |
| HSCOC4_PEA_1_T3 (SEQ ID NO:17) | 886 | 966 |
| HSCOC4_PEA_1_T4 (SEQ ID NO:18) | 886 | 966 |
| HSCOC4_PEA_1_T5 (SEQ ID NO:19) | 886 | 966 |
| HSCOC4_PEA_1_T7 (SEQ ID NO:20) | 886 | 966 |
| HSCOC4_PEA_1_T8 (SEQ ID NO:21) | 886 | 966 |
| HSCOC4_PEA_1_T11 (SEQ ID NO:22) | 886 | 966 |
| HSCOC4_PEA_1_T12 (SEQ ID NO:23) | 886 | 966 |
| HSCOC4_PEA_1_T14 (SEQ ID NO:24) | 886 | 966 |
| HSCOC4_PEA_1_T15 (SEQ ID NO:25) | 886 | 966 |
| HSCOC4_PEA_1_T20 (SEQ ID NO:26) | 886 | 966 |
| HSCOC4_PEA_1_T21 (SEQ ID NO:27) | 886 | 966 |
| HSCOC4_PEA_1_T25 (SEQ ID NO:28) | 886 | 966 |
| HSCOC4_PEA_1_T28 (SEQ ID NO:29) | 886 | 966 |
| HSCOC4_PEA_1_T30 (SEQ ID NO:30) | 886 | 966 |
| HSCOC4_PEA_1_T31 (SEQ ID NO:31) | 886 | 966 |
| HSCOC4_PEA_1_T32 (SEQ ID NO:32) | 886 | 966 |
| HSCOC4_PEA_1_T40 (SEQ ID NO:33) | 886 | 966 |

Segment cluster HSCOC4_PEA_1_node_10 (SEQ ID NO:173) according to the present invention is supported by 33 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_

1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 235 below describes the starting and ending position of this segment on each transcript.

TABLE 235

Segment location on transcripts

| Transcript name | Segment starting position | Segment ending position |
|---|---|---|
| HSCOC4_PEA_1_T1 (SEQ ID NO:15) | 967 | 1037 |
| HSCOC4_PEA_1_T2 (SEQ ID NO:16) | 967 | 1037 |
| HSCOC4_PEA_1_T3 (SEQ ID NO:17) | 967 | 1037 |
| HSCOC4_PEA_1_T4 (SEQ ID NO:18) | 967 | 1037 |
| HSCOC4_PEA_1_T5 (SEQ ID NO:19) | 967 | 1037 |
| HSCOC4_PEA_1_T7 (SEQ ID NO:20) | 967 | 1037 |
| HSCOC4_PEA_1_T8 (SEQ ID NO:21) | 967 | 1037 |
| HSCOC4_PEA_1_T11 (SEQ ID NO:22) | 967 | 1037 |
| HSCOC4_PEA_1_T12 (SEQ ID NO:23) | 967 | 1037 |
| HSCOC4_PEA_1_T14 (SEQ ID NO:24) | 967 | 1037 |
| HSCOC4_PEA_1_T15 (SEQ ID NO:25) | 967 | 1037 |
| HSCOC4_PEA_1_T20 (SEQ ID NO:26) | 967 | 1037 |
| HSCOC4_PEA_1_T21 (SEQ ID NO:27) | 967 | 1037 |
| HSCOC4_PEA_1_T25 (SEQ ID NO:28) | 967 | 1037 |
| HSCOC4_PEA_1_T28 (SEQ ID NO:29) | 967 | 1037 |
| HSCOC4_PEA_1_T30 (SEQ ID NO:30) | 967 | 1037 |
| HSCOC4_PEA_1_T31 (SEQ ID NO:31) | 967 | 1037 |
| HSCOC4_PEA_1_T32 (SEQ ID NO:32) | 967 | 1037 |
| HSCOC4_PEA_1_T40 (SEQ ID NO:33) | 967 | 1037 |

Segment cluster HSCOC4_PEA_1_node_12 (SEQ ID NO:174) according to the present invention is supported by 33 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4 PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 236 below describes the starting and ending position of this segment on each transcript.

TABLE 236

Segment location on transcripts

| Transcript name | Segment starting position | Segment ending position |
|---|---|---|
| HSCOC4_PEA_1_T1 (SEQ ID NO:15) | 1038 | 1126 |
| HSCOC4_PEA_1_T2 (SEQ ID NO:16) | 1038 | 1126 |
| HSCOC4_PEA_1_T3 (SEQ ID NO:17) | 1038 | 1126 |
| HSCOC4_PEA_1_T4 (SEQ ID NO:18) | 1038 | 1126 |
| HSCOC4_PEA_1_T5 (SEQ ID NO:19) | 1038 | 1126 |
| HSCOC4_PEA_1_T7 (SEQ ID NO:20) | 1038 | 1126 |
| HSCOC4_PEA_1_T8 (SEQ ID NO:21) | 1038 | 1126 |
| HSCOC4_PEA_1_T11 (SEQ ID NO:22) | 1038 | 1126 |
| HSCOC4_PEA_1_T12 (SEQ ID NO:23) | 1038 | 1126 |
| HSCOC4_PEA_1_T14 (SEQ ID NO:24) | 1038 | 1126 |
| HSCOC4_PEA_1_T15 (SEQ ID NO:25) | 1038 | 1126 |
| HSCOC4_PEA_1_T20 (SEQ ID NO:26) | 1038 | 1126 |
| HSCOC4_PEA_1_T21 (SEQ ID NO:27) | 1038 | 1126 |
| HSCOC4_PEA_1_T25 (SEQ ID NO:28) | 1038 | 1126 |
| HSCOC4_PEA_1_T28 (SEQ ID NO:29) | 1038 | 1126 |
| HSCOC4_PEA_1_T30 (SEQ ID NO:30) | 1038 | 1126 |
| HSCOC4_PEA_1_T31 (SEQ ID NO:31) | 1038 | 1126 |
| HSCOC4_PEA_1_T32 (SEQ ID NO:32) | 1038 | 1126 |
| HSCOC4_PEA_1_T40 (SEQ ID NO:33) | 1038 | 1126 |

Segment cluster HSCOC4_PEA_1_node_14 (SEQ ID NO:175) according to the present invention is supported by 30 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 237 below describes the starting and ending position of this segment on each transcript.

TABLE 237

Segment location on transcripts

| Transcript name | Segment starting position | Segment ending position |
|---|---|---|
| HSCOC4_PEA_1_T1 (SEQ ID NO:15) | 1127 | 1209 |
| HSCOC4_PEA_1_T2 (SEQ ID NO:16) | 1127 | 1209 |
| HSCOC4_PEA_1_T3 (SEQ ID NO:17) | 1127 | 1209 |
| HSCOC4_PEA_1_T4 (SEQ ID NO:18) | 1127 | 1209 |
| HSCOC4_PEA_1_T5 (SEQ ID NO:19) | 1127 | 1209 |
| HSCOC4_PEA_1_T7 (SEQ ID NO:20) | 1127 | 1209 |
| HSCOC4_PEA_1_T8 (SEQ ID NO:21) | 1127 | 1209 |
| HSCOC4_PEA_1_T11 (SEQ ID NO:22) | 1127 | 1209 |
| HSCOC4_PEA_1_T12 (SEQ ID NO:23) | 1127 | 1209 |
| HSCOC4_PEA_1_T14 (SEQ ID NO:24) | 1127 | 1209 |
| HSCOC4_PEA_1_T15 (SEQ ID NO:25) | 1127 | 1209 |
| HSCOC4_PEA_1_T20 (SEQ ID NO:26) | 1127 | 1209 |
| HSCOC4_PEA_1_T21 (SEQ ID NO:27) | 1127 | 1209 |
| HSCOC4_PEA_1_T25 (SEQ ID NO:28) | 1127 | 1209 |
| HSCOC4_PEA_1_T28 (SEQ ID NO:29) | 1127 | 1209 |
| HSCOC4_PEA_1_T30 (SEQ ID NO:30) | 1127 | 1209 |
| HSCOC4_PEA_1_T31 (SEQ ID NO:31) | 1127 | 1209 |
| HSCOC4_PEA_1_T32 (SEQ ID NO:32) | 1127 | 1209 |
| HSCOC4_PEA_1_T40 (SEQ ID NO:33) | 1127 | 1209 |

Segment cluster HSCOC4_PEA_1_node_17 (SEQ ID NO:176) according to the present invention is supported by 28 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 238 below describes the starting and ending position of this segment on each transcript.

TABLE 238

Segment location on transcripts

| Transcript name | Segment starting position | Segment ending position |
|---|---|---|
| HSCOC4_PEA_1_T1 (SEQ ID NO:15) | 1210 | 1306 |
| HSCOC4_PEA_1_T2 (SEQ ID NO:16) | 1210 | 1306 |
| HSCOC4_PEA_1_T3 (SEQ ID NO:17) | 1210 | 1306 |
| HSCOC4_PEA_1_T4 (SEQ ID NO:18) | 1210 | 1306 |
| HSCOC4_PEA_1_T5 (SEQ ID NO:19) | 1210 | 1306 |
| HSCOC4_PEA_1_T8 (SEQ ID NO:21) | 1210 | 1306 |
| HSCOC4_PEA_1_T11 (SEQ ID NO:22) | 1210 | 1306 |
| HSCOC4_PEA_1_T12 (SEQ ID NO:23) | 1210 | 1306 |
| HSCOC4_PEA_1_T14 (SEQ ID NO:24) | 1210 | 1306 |
| HSCOC4_PEA_1_T15 (SEQ ID NO:25) | 1210 | 1306 |
| HSCOC4_PEA_1_T20 (SEQ ID NO:26) | 1210 | 1306 |
| HSCOC4_PEA_1_T21 (SEQ ID NO:27) | 1210 | 1306 |
| HSCOC4_PEA_1_T25 (SEQ ID NO:28) | 1210 | 1306 |
| HSCOC4_PEA_1_T28 (SEQ ID NO:29) | 1210 | 1306 |
| HSCOC4_PEA_1_T30 (SEQ ID NO:30) | 1210 | 1306 |
| HSCOC4_PEA_1_T31 (SEQ ID NO:31) | 1210 | 1306 |
| HSCOC4_PEA_1_T32 (SEQ ID NO:32) | 1210 | 1306 |
| HSCOC4_PEA_1_T40 (SEQ ID NO:33) | 1210 | 1306 |

Segment cluster HSCOC4_PEA_1_node_19 (SEQ ID NO:177) according to the present invention is supported by 27 libraries. The number of libraries was determined as previously described. This segment can be found in the following transcript(s): HSCOC4_PEA_1_T$_1$ (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4 PEA_1_T25 (SEQ ID NO:28), HSCOC4_PEA_1_T28 (SEQ ID NO:29), HSCOC4 PEA_1_T30 (SEQ ID NO: 30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 239 below describes the starting and ending position of this segment on each transcript.

TABLE 239

Segment location on transcripts

| Transcript name | Segment starting position | Segment ending position |
|---|---|---|
| HSCOC4_PEA_1_T1 (SEQ ID NO:15) | 1307 | 1412 |

TABLE 239-continued

Segment location on transcripts

| Transcript name | Segment starting position | Segment ending position |
|---|---|---|
| HSCOC4_PEA_1_T2 (SEQ ID NO:16) | 1307 | 1412 |
| HSCOC4_PEA_1_T3 (SEQ ID NO:17) | 1307 | 1412 |
| HSCOC4_PEA_1_T4 (SEQ ID NO:18) | 1307 | 1412 |
| HSCOC4_PEA_1_T5 (SEQ ID NO:19) | 1307 | 1412 |
| HSCOC4_PEA_1_T8 (SEQ ID NO:21) | 1307 | 1412 |
| HSCOC4_PEA_1_T11 (SEQ ID NO:22) | 1307 | 1412 |
| HSCOC4_PEA_1_T12 (SEQ ID NO:23) | 1307 | 1412 |
| HSCOC4_PEA_1_T14 (SEQ ID NO:24) | 1307 | 1412 |
| HSCOC4_PEA_1_T15 (SEQ ID NO:25) | 1307 | 1412 |
| HSCOC4_PEA_1_T20 (SEQ ID NO:26) | 1307 | 1412 |
| HSCOC4_PEA_1_T21 (SEQ ID NO:27) | 1307 | 1412 |
| HSCOC4_PEA_1_T25 (SEQ ID NO:28) | 1307 | 1412 |
| HSCOC4_PEA_1_T28 (SEQ ID NO:29) | 1307 | 1412 |
| HSCOC4_PEA_1_T30 (SEQ ID NO:30) | 1307 | 1412 |
| HSCOC4_PEA_1_T31 (SEQ ID NO:31) | 1307 | 1412 |
| HSCOC4_PEA_1_T32 (SEQ ID NO:32) | 1307 | 1412 |
| HSCOC4_PEA_1_T40 (SEQ ID NO:33) | 1307 | 1412 |

Segment cluster HSCOC4_PEA_1_node_21 (SEQ ID NO:178) according to the present invention is supported by 26 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 240 below describes the starting and ending position of this segment on each transcript.

TABLE 240

Segment location on transcripts

| Transcript name | Segment starting position | Segment ending position |
|---|---|---|
| HSCOC4_PEA_1_T1 (SEQ ID NO:15) | 1413 | 1439 |
| HSCOC4_PEA_1_T2 (SEQ ID NO:16) | 1413 | 1439 |
| HSCOC4_PEA_1_T3 (SEQ ID NO:17) | 1413 | 1439 |
| HSCOC4_PEA_1_T4 (SEQ ID NO:18) | 1413 | 1439 |
| HSCOC4_PEA_1_T5 (SEQ ID NO:19) | 1413 | 1439 |
| HSCOC4_PEA_1_T7 (SEQ ID NO:20) | 1210 | 1236 |
| HSCOC4_PEA_1_T8 (SEQ ID NO:21) | 1413 | 1439 |
| HSCOC4_PEA_1_T11 (SEQ ID NO:22) | 1413 | 1439 |
| HSCOC4_PEA_1_T12 (SEQ ID NO:23) | 1413 | 1439 |
| HSCOC4_PEA_1_T14 (SEQ ID NO:24) | 1413 | 1439 |
| HSCOC4_PEA_1_T15 (SEQ ID NO:25) | 1413 | 1439 |
| HSCOC4_PEA_1_T20 (SEQ ID NO:26) | 1413 | 1439 |
| HSCOC4_PEA_1_T21 (SEQ ID NO:27) | 1413 | 1439 |
| HSCOC4_PEA_1_T25 (SEQ ID NO:28) | 1413 | 1439 |
| HSCOC4_PEA_1_T28 (SEQ ID NO:29) | 1413 | 1439 |
| HSCOC4_PEA_1_T30 (SEQ ID NO:30) | 1413 | 1439 |
| HSCOC4_PEA_1_T31 (SEQ ID NO:31) | 1413 | 1439 |
| HSCOC4_PEA_1_T32 (SEQ ID NO:32) | 1413 | 1439 |
| HSCOC4_PEA_1_T40 (SEQ ID NO:33) | 1413 | 1439 |

Segment cluster HSCOC4_PEA_1_node_22 (SEQ ID NO:179) according to the present invention is supported by 26 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 241 below describes the starting and ending position of this segment on each transcript.

TABLE 241

Segment location on transcripts

| Transcript name | Segment starting position | Segment ending position |
|---|---|---|
| HSCOC4_PEA_1_T1 (SEQ ID NO:15) | 1440 | 1545 |

TABLE 241-continued

Segment location on transcripts

| Transcript name | Segment starting position | Segment ending position |
|---|---|---|
| HSCOC4_PEA_1_T2 (SEQ ID NO:16) | 1440 | 1545 |
| HSCOC4_PEA_1_T3 (SEQ ID NO:17) | 1440 | 1545 |
| HSCOC4_PEA_1_T4 (SEQ ID NO:18) | 1440 | 1545 |
| HSCOC4_PEA_1_T5 (SEQ ID NO:19) | 1440 | 1545 |
| HSCOC4_PEA_1_T7 (SEQ ID NO:20) | 1237 | 1342 |
| HSCOC4_PEA_1_T8 (SEQ ID NO:21) | 1440 | 1545 |
| HSCOC4_PEA_1_T11 (SEQ ID NO:22) | 1440 | 1545 |
| HSCOC4_PEA_1_T12 (SEQ ID NO:23) | 1440 | 1545 |
| HSCOC4_PEA_1_T14 (SEQ ID NO:24) | 1440 | 1545 |
| HSCOC4_PEA_1_T15 (SEQ ID NO:25) | 1440 | 1545 |
| HSCOC4_PEA_1_T20 (SEQ ID NO:26) | 1440 | 1545 |
| HSCOC4_PEA_1_T21 (SEQ ID NO:27) | 1440 | 1545 |
| HSCOC4_PEA_1_T25 (SEQ ID NO:28) | 1440 | 1545 |
| HSCOC4_PEA_1_T28 (SEQ ID NO:29) | 1440 | 1545 |
| HSCOC4_PEA_1_T30 (SEQ ID NO:30) | 1440 | 1545 |
| HSCOC4_PEA_1_T31 (SEQ ID NO:31) | 1440 | 1545 |
| HSCOC4_PEA_1_T32 (SEQ ID NO:32) | 1440 | 1545 |
| HSCOC4_PEA_1_T40 (SEQ ID NO:33) | 1440 | 1545 |

Segment cluster HSCOC4_PEA_1_node_28 (SEQ ID NO:180) according to the present invention is supported by 34 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_T40 (SEQ ID NO:33). Table 242 below describes the starting and ending position of this segment on each transcript.

TABLE 242

Segment location on transcripts

| Transcript name | Segment starting position | Segment ending position |
|---|---|---|
| HSCOC4_PEA_1_T1 (SEQ ID NO:15) | 1546 | 1661 |

TABLE 242-continued

Segment location on transcripts

| Transcript name | Segment starting position | Segment ending position |
|---|---|---|
| HSCOC4_PEA_1_T2 (SEQ ID NO:16) | 1546 | 1661 |
| HSCOC4_PEA_1_T3 (SEQ ID NO:17) | 1546 | 1661 |
| HSCOC4_PEA_1_T4 (SEQ ID NO:18) | 1546 | 1661 |
| HSCOC4_PEA_1_T5 (SEQ ID NO:19) | 1546 | 1661 |
| HSCOC4_PEA_1_T7 (SEQ ID NO:20) | 1343 | 1458 |
| HSCOC4_PEA_1_T8 (SEQ ID NO:21) | 1546 | 1661 |
| HSCOC4_PEA_1_T11 (SEQ ID NO:22) | 1546 | 1661 |
| HSCOC4_PEA_1_T12 (SEQ ID NO:23) | 1546 | 1661 |
| HSCOC4_PEA_1_T14 (SEQ ID NO:24) | 1546 | 1661 |
| HSCOC4_PEA_1_T15 (SEQ ID NO:25) | 1546 | 1661 |
| HSCOC4_PEA_1_T20 (SEQ ID NO:26) | 1546 | 1661 |
| HSCOC4_PEA_1_T21 (SEQ ID NO:27) | 1546 | 1661 |
| HSCOC4_PEA_1_T25 (SEQ ID NO:28) | 1546 | 1661 |
| HSCOC4_PEA_1_T28 (SEQ ID NO:29) | 1546 | 1661 |
| HSCOC4_PEA_1_T30 (SEQ ID NO:30) | 1546 | 1661 |
| HSCOC4_PEA_1_T31 (SEQ ID NO:31) | 1546 | 1661 |
| HSCOC4_PEA_1_T32 (SEQ ID NO:32) | 1546 | 1661 |
| HSCOC4_PEA_1_T40 (SEQ ID NO:33) | 1546 | 1661 |

Segment cluster HSCOC4_PEA_1_node_29 (SEQ ID NO:181) according to the present invention is supported by 5 libraries. The number of libraries was determined as previously described. This segment can be found in the following transcript(s): HSCOC4_PEA_1_T5 (SEQ ID NO:19). Table 243 below describes the starting and ending position of this segment on each transcript.

TABLE 243

Segment location on transcripts

| Transcript name | Segment starting position | Segment ending position |
|---|---|---|
| HSCOC4_PEA_1_T5 (SEQ ID NO:19) | 1662 | 1760 |

Segment cluster HSCOC4_PEA_1_node_41 (SEQ ID NO:182) according to the present invention is supported by 32 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 244 below describes the starting and ending position of this segment on each transcript.

TABLE 244

Segment location on transcripts

| Transcript name | Segment starting position | Segment ending position |
| --- | --- | --- |
| HSCOC4_PEA_1_T1 (SEQ ID NO:15) | 2497 | 2571 |
| HSCOC4_PEA_1_T2 (SEQ ID NO:16) | 2497 | 2571 |
| HSCOC4_PEA_1_T3 (SEQ ID NO:17) | 2497 | 2571 |
| HSCOC4_PEA_1_T4 (SEQ ID NO:18) | 2497 | 2571 |
| HSCOC4_PEA_1_T5 (SEQ ID NO:19) | 2596 | 2670 |
| HSCOC4_PEA_1_T7 (SEQ ID NO:20) | 2294 | 2368 |
| HSCOC4_PEA_1_T8 (SEQ ID NO:21) | 2497 | 2571 |
| HSCOC4_PEA_1_T11 (SEQ ID NO:22) | 2497 | 2571 |
| HSCOC4_PEA_1_T12 (SEQ ID NO:23) | 2497 | 2571 |
| HSCOC4_PEA_1_T14 (SEQ ID NO:24) | 2497 | 2571 |
| HSCOC4_PEA_1_T15 (SEQ ID NO:25) | 2497 | 2571 |
| HSCOC4_PEA_1_T20 (SEQ ID NO:26) | 2497 | 2571 |
| HSCOC4_PEA_1_T21 (SEQ ID NO:27) | 2497 | 2571 |
| HSCOC4_PEA_1_T25 (SEQ ID NO:28) | 2497 | 2571 |
| HSCOC4_PEA_1_T28 (SEQ ID NO:29) | 2497 | 2571 |
| HSCOC4_PEA_1_T30 (SEQ ID NO:30) | 2497 | 2571 |
| HSCOC4_PEA_1_T31 (SEQ ID NO:31) | 2497 | 2571 |
| HSCOC4_PEA_1_T32 (SEQ ID NO:32) | 2497 | 2571 |
| HSCOC4_PEA_1_T40 (SEQ ID NO:33) | 2497 | 2571 |

Segment cluster HSCOC4_PEA_1_node_45 (SEQ ID NO:183) according to the present invention is supported by 31 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 245 below describes the starting and ending position of this segment on each transcript.

TABLE 245

Segment location on transcripts

| Transcript name | Segment starting position | Segment ending position |
| --- | --- | --- |
| HSCOC4_PEA_1_T1 (SEQ ID NO:15) | 2770 | 2881 |
| HSCOC4_PEA_1_T2 (SEQ ID NO:16) | 2770 | 2881 |
| HSCOC4_PEA_1_T3 (SEQ ID NO:17) | 2770 | 2881 |
| HSCOC4_PEA_1_T4 (SEQ ID NO:18) | 2770 | 2881 |
| HSCOC4_PEA_1_T5 (SEQ ID NO:19) | 2869 | 2980 |
| HSCOC4_PEA_1_T7 (SEQ ID NO:20) | 2567 | 2678 |
| HSCOC4_PEA_1_T8 (SEQ ID NO:21) | 2770 | 2881 |
| HSCOC4_PEA_1_T11 (SEQ ID NO:22) | 2770 | 2881 |
| HSCOC4_PEA_1_T12 (SEQ ID NO:23) | 2770 | 2881 |
| HSCOC4_PEA_1_T14 (SEQ ID NO:24) | 2770 | 2881 |
| HSCOC4_PEA_1_T15 (SEQ ID NO:25) | 2770 | 2881 |
| HSCOC4_PEA_1_T20 (SEQ ID NO:26) | 2770 | 2881 |
| HSCOC4_PEA_1_T21 (SEQ ID NO:27) | 2770 | 2881 |
| HSCOC4_PEA_1_T25 (SEQ ID NO:28) | 2770 | 2881 |
| HSCOC4_PEA_1_T28 (SEQ ID NO:29) | 2770 | 2881 |
| HSCOC4_PEA_1_T30 (SEQ ID NO:30) | 2770 | 2881 |
| HSCOC4_PEA_1_T31 (SEQ ID NO:31) | 2770 | 2881 |
| HSCOC4_PEA_1_T32 (SEQ ID NO:32) | 2770 | 2881 |
| HSCOC4_PEA_1_T40 (SEQ ID NO:33) | 2770 | 2881 |

Segment cluster HSCOC4_PEA_1_node_47 (SEQ ID NO:184) according to the present invention is supported by 32 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA 1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 246 below describes the starting and ending position of this segment on each transcript.

TABLE 246

Segment location on transcripts

| Transcript name | Segment starting position | Segment ending position |
|---|---|---|
| HSCOC4_PEA_1_T1 (SEQ ID NO:15) | 2882 | 2952 |
| HSCOC4_PEA_1_T2 (SEQ ID NO:16) | 2882 | 2952 |
| HSCOC4_PEA_1_T3 (SEQ ID NO:17) | 2882 | 2952 |
| HSCOC4_PEA_1_T4 (SEQ ID NO:18) | 2882 | 2952 |
| HSCOC4_PEA_1_T5 (SEQ ID NO:19) | 2981 | 3051 |
| HSCOC4_PEA_1_T7 (SEQ ID NO:20) | 2679 | 2749 |
| HSCOC4_PEA_1_T8 (SEQ ID NO:21) | 2882 | 2952 |
| HSCOC4_PEA_1_T11 (SEQ ID NO:22) | 2882 | 2952 |
| HSCOC4_PEA_1_T12 (SEQ ID NO:23) | 2882 | 2952 |
| HSCOC4_PEA_1_T14 (SEQ ID NO:24) | 2882 | 2952 |
| HSCOC4_PEA_1_T15 (SEQ ID NO:25) | 2882 | 2952 |
| HSCOC4_PEA_1_T20 (SEQ ID NO:26) | 2882 | 2952 |
| HSCOC4_PEA_1_T21 (SEQ ID NO:27) | 2882 | 2952 |
| HSCOC4_PEA_1_T25 (SEQ ID NO:28) | 2882 | 2952 |
| HSCOC4_PEA_1_T28 (SEQ ID NO:29) | 2882 | 2952 |
| HSCOC4_PEA_1_T30 (SEQ ID NO:30) | 2882 | 2952 |
| HSCOC4_PEA_1_T31 (SEQ ID NO:31) | 2882 | 2952 |
| HSCOC4_PEA_1_T32 (SEQ ID NO:32) | 2882 | 2952 |
| HSCOC4_PEA_1_T40 (SEQ ID NO:33) | 2882 | 2952 |

Segment cluster HSCOC4_PEA_1_node_50 (SEQ ID NO:185) according to the present invention is supported by 5 libraries. The number of libraries was determined as previously described. This segment can be found in the following transcript(s): HSCOC4_PEA_1_T1 (SEQ ID NO:15) and HSCOC4_PEA_1_T3 (SEQ ID NO:17). Table 247 below describes the starting and ending position of this segment on each transcript.

TABLE 247

Segment location on transcripts

| Transcript name | Segment starting position | Segment ending position |
|---|---|---|
| HSCOC4_PEA_1_T1 (SEQ ID NO:15) | 3093 | 3205 |
| HSCOC4_PEA_1_T3 (SEQ ID NO:17) | 3351 | 3463 |

Segment cluster HSCOC4_PEA_1_node_53 (SEQ ID NO:186) according to the present invention is supported by 38 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 248 below describes the starting and ending position of this segment on each transcript.

TABLE 248

Segment location on transcripts

| Transcript name | Segment starting position | Segment ending position |
|---|---|---|
| HSCOC4_PEA_1_T1 (SEQ ID NO:15) | 3416 | 3467 |
| HSCOC4_PEA_1_T2 (SEQ ID NO:16) | 3561 | 3612 |
| HSCOC4_PEA_1_T3 (SEQ ID NO:17) | 3674 | 3725 |
| HSCOC4_PEA_1_T4 (SEQ ID NO:18) | 3303 | 3354 |
| HSCOC4_PEA_1_T5 (SEQ ID NO:19) | 3402 | 3453 |
| HSCOC4_PEA_1_T7 (SEQ ID NO:20) | 3100 | 3151 |
| HSCOC4_PEA_1_T8 (SEQ ID NO:21) | 3303 | 3354 |
| HSCOC4_PEA_1_T11 (SEQ ID NO:22) | 3303 | 3354 |
| HSCOC4_PEA_1_T12 (SEQ ID NO:23) | 3303 | 3354 |
| HSCOC4_PEA_1_T14 (SEQ ID NO:24) | 3303 | 3354 |
| HSCOC4_PEA_1_T15 (SEQ ID NO:25) | 3303 | 3354 |
| HSCOC4_PEA_1_T20 (SEQ ID NO:26) | 3303 | 3354 |
| HSCOC4_PEA_1_T21 (SEQ ID NO:27) | 3303 | 3354 |
| HSCOC4_PEA_1_T25 (SEQ ID NO:28) | 3303 | 3354 |
| HSCOC4_PEA_1_T28 (SEQ ID NO:29) | 3303 | 3354 |
| HSCOC4_PEA_1_T30 (SEQ ID NO:30) | 3303 | 3354 |
| HSCOC4_PEA_1_T31 (SEQ ID NO:31) | 3303 | 3354 |
| HSCOC4_PEA_1_T32 (SEQ ID NO:32) | 3303 | 3354 |
| HSCOC4_PEA_1_T40 (SEQ ID NO:33) | 3303 | 3354 |

Segment cluster HSCOC4_PEA_1_node_55 (SEQ ID NO:187) according to the present invention is supported by 40 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_

1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33).Table 249 below describes the starting and ending position of this segment on each transcript.

TABLE 249

Segment location on transcripts

| Transcript name | Segment starting position | Segment ending position |
|---|---|---|
| HSCOC4_PEA_1_T1 (SEQ ID NO:15) | 3468 | 3557 |
| HSCOC4_PEA_1_T2 (SEQ ID NO:16) | 3613 | 3702 |
| HSCOC4_PEA_1_T3 (SEQ ID NO:17) | 3726 | 3815 |
| HSCOC4_PEA_1_T4 (SEQ ID NO:18) | 3355 | 3444 |
| HSCOC4_PEA_1_T5 (SEQ ID NO:19) | 3454 | 3543 |
| HSCOC4_PEA_1_T7 (SEQ ID NO:20) | 3152 | 3241 |
| HSCOC4_PEA_1_T8 (SEQ ID NO:21) | 3355 | 3444 |
| HSCOC4_PEA_1_T11 (SEQ ID NO:22) | 3355 | 3444 |
| HSCOC4_PEA_1_T12 (SEQ ID NO:23) | 3355 | 3444 |
| HSCOC4_PEA_1_T14 (SEQ ID NO:24) | 3355 | 3444 |
| HSCOC4_PEA_1_T15 (SEQ ID NO:25) | 3355 | 3444 |
| HSCOC4_PEA_1_T20 (SEQ ID NO:26) | 3355 | 3444 |
| HSCOC4_PEA_1_T21 (SEQ ID NO:27) | 3355 | 3444 |
| HSCOC4_PEA_1_T25 (SEQ ID NO:28) | 3355 | 3444 |
| HSCOC4_PEA_1_T28 (SEQ ID NO:29) | 3355 | 3444 |
| HSCOC4_PEA_1_T30 (SEQ ID NO:30) | 3355 | 3444 |
| HSCOC4_PEA_1_T31 (SEQ ID NO:31) | 3355 | 3444 |
| HSCOC4_PEA_1_T32 (SEQ ID NO:32) | 3355 | 3444 |
| HSCOC4_PEA_1_T40 (SEQ ID NO:33) | 3355 | 3444 |

TABLE 250

Segment location on transcripts

| Transcript name | Segment starting position | Segment ending position |
|---|---|---|
| HSCOC4_PEA_1_T1 (SEQ ID NO:15) | 3558 | 3604 |
| HSCOC4_PEA_1_T2 (SEQ ID NO:16) | 3703 | 3749 |
| HSCOC4_PEA_1_T3 (SEQ ID NO:17) | 3816 | 3862 |
| HSCOC4_PEA_1_T4 (SEQ ID NO:18) | 3445 | 3491 |
| HSCOC4_PEA_1_T5 (SEQ ID NO:19) | 3544 | 3590 |
| HSCOC4_PEA_1_T7 (SEQ ID NO:20) | 3242 | 3288 |
| HSCOC4_PEA_1_T8 (SEQ ID NO:21) | 3445 | 3491 |
| HSCOC4_PEA_1_T11 (SEQ ID NO:22) | 3445 | 3491 |
| HSCOC4_PEA_1_T12 (SEQ ID NO:23) | 3445 | 3491 |
| HSCOC4_PEA_1_T14 (SEQ ID NO:24) | 3445 | 3491 |
| HSCOC4_PEA_1_T15 (SEQ ID NO:25) | 3445 | 3491 |
| HSCOC4_PEA_1_T20 (SEQ ID NO:26) | 3445 | 3491 |
| HSCOC4_PEA_1_T21 (SEQ ID NO:27) | 3445 | 3491 |
| HSCOC4_PEA_1_T25 (SEQ ID NO:28) | 3445 | 3491 |
| HSCOC4_PEA_1_T28 (SEQ ID NO:29) | 3445 | 3491 |
| HSCOC4_PEA_1_T30 (SEQ ID NO:30) | 3445 | 3491 |
| HSCOC4_PEA_1_T31 (SEQ ID NO:31) | 3445 | 3491 |
| HSCOC4_PEA_1_T32 (SEQ ID NO:32) | 3445 | 3491 |
| HSCOC4_PEA_1_T40 (SEQ ID NO:33) | 3445 | 3491 |

Segment cluster HSCOC4_PEA_1_node_57 (SEQ ID NO:188) according to the present invention is supported by 42 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 250 below describes the starting and ending position of this segment on each transcript.

Segment cluster HSCOC4_PEA_1_node_60 (SEQ ID NO:189) according to the present invention is supported by 50 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 251 below describes the starting and ending position of this segment on each transcript.

TABLE 251

Segment location on transcripts

| Transcript name | Segment starting position | Segment ending position |
|---|---|---|
| HSCOC4_PEA_1_T1 (SEQ ID NO:15) | 3768 | 3843 |
| HSCOC4_PEA_1_T2 (SEQ ID NO:16) | 3913 | 3988 |
| HSCOC4_PEA_1_T3 (SEQ ID NO:17) | 4026 | 4101 |
| HSCOC4_PEA_1_T4 (SEQ ID NO:18) | 3834 | 3909 |
| HSCOC4_PEA_1_T5 (SEQ ID NO:19) | 3754 | 3829 |
| HSCOC4_PEA_1_T7 (SEQ ID NO:20) | 3452 | 3527 |
| HSCOC4_PEA_1_T8 (SEQ ID NO:21) | 3655 | 3730 |
| HSCOC4_PEA_1_T11 (SEQ ID NO:22) | 3655 | 3730 |
| HSCOC4_PEA_1_T12 (SEQ ID NO:23) | 3655 | 3730 |
| HSCOC4_PEA_1_T14 (SEQ ID NO:24) | 3655 | 3730 |
| HSCOC4_PEA_1_T15 (SEQ ID NO:25) | 3655 | 3730 |
| HSCOC4_PEA_1_T20 (SEQ ID NO:26) | 3655 | 3730 |
| HSCOC4_PEA_1_T21 (SEQ ID NO:27) | 3655 | 3730 |
| HSCOC4_PEA_1_T25 (SEQ ID NO:28) | 3655 | 3730 |
| HSCOC4_PEA_1_T28 (SEQ ID NO:29) | 3655 | 3730 |
| HSCOC4_PEA_1_T30 (SEQ ID NO:30) | 3655 | 3730 |
| HSCOC4_PEA_1_T31 (SEQ ID NO:31) | 3655 | 3730 |
| HSCOC4_PEA_1_T32 (SEQ ID NO:32) | 3655 | 3730 |
| HSCOC4_PEA_1_T40 (SEQ ID NO:33) | 3655 | 3730 |

Segment cluster HSCOC4_PEA_1_node_64 (SEQ ID NO:190) according to the present invention is supported by 65 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA 1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 252 below describes the starting and ending position of this segment on each transcript.

TABLE 252

Segment location on transcripts

| Transcript name | Segment starting position | Segment ending position |
|---|---|---|
| HSCOC4_PEA_1_T1 (SEQ ID NO:15) | 4001 | 4117 |
| HSCOC4_PEA_1_T2 (SEQ ID NO:16) | 4146 | 4262 |
| HSCOC4_PEA_1_T3 (SEQ ID NO:17) | 4259 | 4375 |
| HSCOC4_PEA_1_T4 (SEQ ID NO:18) | 4067 | 4183 |
| HSCOC4_PEA_1_T5 (SEQ ID NO:19) | 3987 | 4103 |
| HSCOC4_PEA_1_T7 (SEQ ID NO:20) | 3685 | 3801 |
| HSCOC4_PEA_1_T8 (SEQ ID NO:21) | 3888 | 4004 |
| HSCOC4_PEA_1_T11 (SEQ ID NO:22) | 3888 | 4004 |
| HSCOC4_PEA_1_T12 (SEQ ID NO:23) | 3888 | 4004 |
| HSCOC4_PEA_1_T14 (SEQ ID NO:24) | 3888 | 4004 |
| HSCOC4_PEA_1_T15 (SEQ ID NO:25) | 3888 | 4004 |
| HSCOC4_PEA_1_T20 (SEQ ID NO:26) | 3888 | 4004 |
| HSCOC4_PEA_1_T21 (SEQ ID NO:27) | 3888 | 4004 |
| HSCOC4_PEA_1_T25 (SEQ ID NO:28) | 3888 | 4004 |
| HSCOC4_PEA_1_T28 (SEQ ID NO:29) | 3888 | 4004 |
| HSCOC4_PEA_1_T30 (SEQ ID NO:30) | 3888 | 4004 |
| HSCOC4_PEA_1_T31 (SEQ ID NO:31) | 3888 | 4004 |
| HSCOC4_PEA_1_T32 (SEQ ID NO:32) | 3888 | 4004 |
| HSCOC4_PEA_1_T40 (SEQ ID NO:33) | 3888 | 4004 |

Segment cluster HSCOC4_PEA_1_node_69 (SEQ ID NO:191) according to the present invention can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4 PEA_1_T8 (SEQ ID NO:21), HSCOC4_PEA_1_T 11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 253 below describes the starting and ending position of this segment on each transcript.

TABLE 253

Segment location on transcripts

| Transcript name | Segment starting position | Segment ending position |
|---|---|---|
| HSCOC4_PEA_1_T1 (SEQ ID NO:15) | 4290 | 4309 |

TABLE 253-continued

Segment location on transcripts

| Transcript name | Segment starting position | Segment ending position |
|---|---|---|
| HSCOC4_PEA_1_T2 (SEQ ID NO:16) | 4435 | 4454 |
| HSCOC4_PEA_1_T3 (SEQ ID NO:17) | 4548 | 4567 |
| HSCOC4_PEA_1_T4 (SEQ ID NO:18) | 4356 | 4375 |
| HSCOC4_PEA_1_T5 (SEQ ID NO:19) | 4276 | 4295 |
| HSCOC4_PEA_1_T7 (SEQ ID NO:20) | 3974 | 3993 |
| HSCOC4_PEA_1_T8 (SEQ ID NO:21) | 4177 | 4196 |
| HSCOC4_PEA_1_T11 (SEQ ID NO:22) | 4177 | 4196 |
| HSCOC4_PEA_1_T12 (SEQ ID NO:23) | 4177 | 4196 |
| HSCOC4_PEA_1_T14 (SEQ ID NO:24) | 4177 | 4196 |
| HSCOC4_PEA_1_T15 (SEQ ID NO:25) | 4177 | 4196 |
| HSCOC4_PEA_1_T20 (SEQ ID NO:26) | 4177 | 4196 |
| HSCOC4_PEA_1_T21 (SEQ ID NO:27) | 4177 | 4196 |
| HSCOC4_PEA_1_T25 (SEQ ID NO:28) | 4177 | 4196 |
| HSCOC4_PEA_1_T28 (SEQ ID NO:29) | 4177 | 4196 |
| HSCOC4_PEA_1_T30 (SEQ ID NO:30) | 4177 | 4196 |
| HSCOC4_PEA_1_T31 (SEQ ID NO:31) | 4177 | 4196 |
| HSCOC4_PEA_1_T32 (SEQ ID NO:32) | 4177 | 4196 |
| HSCOC4_PEA_1_T40 (SEQ ID NO:33) | 4177 | 4196 |

Segment cluster HSCOC4_PEA_1_node_70 (SEQ ID NO:192) according to the present invention is supported by 58 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA 1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA 1_T11 (SEQ ID NO:22), HSCOC4 PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA_1_T32 (SEQ ID NO:32). Table 254 below describes the starting and ending position of this segment on each transcript.

TABLE 254

Segment location on transcripts

| Transcript name | Segment starting position | Segment ending position |
|---|---|---|
| HSCOC4_PEA_1_T1 (SEQ ID NO:15) | 4310 | 4349 |

TABLE 254-continued

Segment location on transcripts

| Transcript name | Segment starting position | Segment ending position |
|---|---|---|
| HSCOC4_PEA_1_T2 (SEQ ID NO:16) | 4455 | 4494 |
| HSCOC4_PEA_1_T3 (SEQ ID NO:17) | 4568 | 4607 |
| HSCOC4_PEA_1_T4 (SEQ ID NO:18) | 4376 | 4415 |
| HSCOC4_PEA_1_T5 (SEQ ID NO:19) | 4296 | 4335 |
| HSCOC4_PEA_1_T7 (SEQ ID NO:20) | 3994 | 4033 |
| HSCOC4_PEA_1_T8 (SEQ ID NO:21) | 4197 | 4236 |
| HSCOC4_PEA_1_T11 (SEQ ID NO:22) | 4197 | 4236 |
| HSCOC4_PEA_1_T12 (SEQ ID NO:23) | 4197 | 4236 |
| HSCOC4_PEA_1_T14 (SEQ ID NO:24) | 4197 | 4236 |
| HSCOC4_PEA_1_T15 (SEQ ID NO:25) | 4197 | 4236 |
| HSCOC4_PEA_1_T20 (SEQ ID NO:26) | 4197 | 4236 |
| HSCOC4_PEA_1_T21 (SEQ ID NO:27) | 4197 | 4236 |
| HSCOC4_PEA_1_T25 (SEQ ID NO:28) | 4197 | 4236 |
| HSCOC4_PEA_1_T28 (SEQ ID NO:29) | 4197 | 4236 |
| HSCOC4_PEA_1_T30 (SEQ ID NO:30) | 4197 | 4236 |
| HSCOC4_PEA_1_T31 (SEQ ID NO:31) | 4197 | 4236 |
| HSCOC4_PEA_1_T32 (SEQ ID NO:32) | 4197 | 4236 |

Segment cluster HSCOC4_PEA_1_node_71 (SEQ ID NO:193) according to the present invention is supported by 58 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA_1_T32 (SEQ ID NO:32). Table 255 below describes the starting and ending position of this segment on each transcript.

TABLE 255

Segment location on transcripts

| Transcript name | Segment starting position | Segment ending position |
|---|---|---|
| HSCOC4_PEA_1_T1 (SEQ ID NO:15) | 4350 | 4391 |
| HSCOC4_PEA_1_T2 (SEQ ID NO:16) | 4495 | 4536 |

TABLE 255-continued

Segment location on transcripts

| Transcript name | Segment starting position | Segment ending position |
|---|---|---|
| HSCOC4_PEA_1_T3 (SEQ ID NO:17) | 4608 | 4649 |
| HSCOC4_PEA_1_T4 (SEQ ID NO:18) | 4416 | 4457 |
| HSCOC4_PEA_1_T5 (SEQ ID NO:19) | 4336 | 4377 |
| HSCOC4_PEA_1_T7 (SEQ ID NO:20) | 4034 | 4075 |
| HSCOC4_PEA_1_T8 (SEQ ID NO:21) | 4237 | 4278 |
| HSCOC4_PEA_1_T11 (SEQ ID NO:22) | 4237 | 4278 |
| HSCOC4_PEA_1_T12 (SEQ ID NO:23) | 4237 | 4278 |
| HSCOC4_PEA_1_T14 (SEQ ID NO:24) | 4237 | 4278 |
| HSCOC4_PEA_1_T15 (SEQ ID NO:25) | 4237 | 4278 |
| HSCOC4_PEA_1_T20 (SEQ ID NO:26) | 4237 | 4278 |
| HSCOC4_PEA_1_T21 (SEQ ID NO:27) | 4237 | 4278 |
| HSCOC4_PEA_1_T25 (SEQ ID NO:28) | 4237 | 4278 |
| HSCOC4_PEA_1_T28 (SEQ ID NO:29) | 4237 | 4278 |
| HSCOC4_PEA_1_T30 (SEQ ID NO:30) | 4237 | 4278 |
| HSCOC4_PEA_1_T31 (SEQ ID NO:31) | 4237 | 4278 |
| HSCOC4_PEA_1_T32 (SEQ ID NO:32) | 4237 | 4278 |

Segment cluster HSCOC4_PEA_1_node_73 (SEQ ID NO:194) according to the present invention is supported by 1 libraries. The number of libraries was determined as previously described. This segment can be found in the following transcript(s): HSCOC4_PEA_1_T20 (SEQ ID NO:26). Table 256 below describes the starting and ending position of this segment on each transcript.

TABLE 256

Segment location on transcripts

| Transcript name | Segment starting position | Segment ending position |
|---|---|---|
| HSCOC4_PEA_1_T20 (SEQ ID NO:26) | 4410 | 4491 |

Segment cluster HSCOC4_PEA_1_node_74 (SEQ ID NO:195) according to the present invention can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA_1_T32 (SEQ ID NO:32). Table 257 below describes the starting and ending position of this segment on each transcript.

TABLE 257

Segment location on transcripts

| Transcript name | Segment starting position | Segment ending position |
|---|---|---|
| HSCOC4_PEA_1_T1 (SEQ ID NO:15) | 4523 | 4546 |
| HSCOC4_PEA_1_T2 (SEQ ID NO:16) | 4668 | 4691 |
| HSCOC4_PEA_1_T3 (SEQ ID NO:17) | 4781 | 4804 |
| HSCOC4_PEA_1_T4 (SEQ ID NO:18) | 4589 | 4612 |
| HSCOC4_PEA_1_T5 (SEQ ID NO:19) | 4509 | 4532 |
| HSCOC4_PEA_1_T7 (SEQ ID NO:20) | 4207 | 4230 |
| HSCOC4_PEA_1_T8 (SEQ ID NO:21) | 4410 | 4433 |
| HSCOC4_PEA_1_T11 (SEQ ID NO:22) | 4410 | 4433 |
| HSCOC4_PEA_1_T12 (SEQ ID NO:23) | 4410 | 4433 |
| HSCOC4_PEA_1_T14 (SEQ ID NO:24) | 4410 | 4433 |
| HSCOC4_PEA_1_T15 (SEQ ID NO:25) | 4410 | 4433 |
| HSCOC4_PEA_1_T20 (SEQ ID NO:26) | 4492 | 4515 |
| HSCOC4_PEA_1_T21 (SEQ ID NO:27) | 4410 | 4433 |
| HSCOC4_PEA_1_T25 (SEQ ID NO:28) | 4410 | 4433 |
| HSCOC4_PEA_1_T28 (SEQ ID NO:29) | 4410 | 4433 |
| HSCOC4_PEA_1_T30 (SEQ ID NO:30) | 4410 | 4433 |
| HSCOC4_PEA_1_T31 (SEQ ID NO:31) | 4410 | 4433 |
| HSCOC4_PEA_1_T32 (SEQ ID NO:32) | 4410 | 4433 |

Segment cluster HSCOC4_PEA_1_node_75 (SEQ ID NO:196) according to the present invention is supported by 65 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA 1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA 1 T32 (SEQ ID NO:32). Table 258 below describes the starting and ending position of this segment on each transcript.

TABLE 258

Segment location on transcripts

| Transcript name | Segment starting position | Segment ending position |
|---|---|---|
| HSCOC4_PEA_1_T1 (SEQ ID NO:15) | 4547 | 4626 |
| HSCOC4_PEA_1_T2 (SEQ ID NO:16) | 4692 | 4771 |
| HSCOC4_PEA_1_T3 (SEQ ID NO:17) | 4805 | 4884 |
| HSCOC4_PEA_1_T4 (SEQ ID NO:18) | 4613 | 4692 |
| HSCOC4_PEA_1_T5 (SEQ ID NO:19) | 4533 | 4612 |
| HSCOC4_PEA_1_T7 (SEQ ID NO:20) | 4231 | 4310 |
| HSCOC4_PEA_1_T8 (SEQ ID NO:21) | 4434 | 4513 |
| HSCOC4_PEA_1_T11 (SEQ ID NO:22) | 4434 | 4513 |
| HSCOC4_PEA_1_T12 (SEQ ID NO:23) | 4434 | 4513 |
| HSCOC4_PEA_1_T14 (SEQ ID NO:24) | 4434 | 4513 |
| HSCOC4_PEA_1_T15 (SEQ ID NO:25) | 4434 | 4513 |
| HSCOC4_PEA_1_T20 (SEQ ID NO:26) | 4516 | 4595 |
| HSCOC4_PEA_1_T21 (SEQ ID NO:27) | 4434 | 4513 |
| HSCOC4_PEA_1_T25 (SEQ ID NO:28) | 4434 | 4513 |
| HSCOC4_PEA_1_T28 (SEQ ID NO:29) | 4434 | 4513 |
| HSCOC4_PEA_1_T30 (SEQ ID NO:30) | 4434 | 4513 |
| HSCOC4_PEA_1_T31 (SEQ ID NO:31) | 4434 | 4513 |
| HSCOC4_PEA_1_T32 (SEQ ID NO:32) | 4434 | 4513 |

Segment cluster HSCOC4_PEA_1_node_76 (SEQ ID NO:197) according to the present invention is supported by 66 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4 PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA_1_T32 (SEQ ID NO:32). Table 259 below describes the starting and ending position of this segment on each transcript.

TABLE 259

Segment location on transcripts

| Transcript name | Segment starting position | Segment ending position |
|---|---|---|
| HSCOC4_PEA_1_T1 (SEQ ID NO:15) | 4627 | 4690 |
| HSCOC4_PEA_1_T2 (SEQ ID NO:16) | 4772 | 4835 |
| HSCOC4_PEA_1_T3 (SEQ ID NO:17) | 4885 | 4948 |
| HSCOC4_PEA_1_T4 (SEQ ID NO:18) | 4693 | 4756 |
| HSCOC4_PEA_1_T5 (SEQ ID NO:19) | 4613 | 4676 |
| HSCOC4_PEA_1_T7 (SEQ ID NO:20) | 4311 | 4374 |
| HSCOC4_PEA_1_T8 (SEQ ID NO:21) | 4514 | 4577 |
| HSCOC4_PEA_1_T11 (SEQ ID NO:22) | 4514 | 4577 |
| HSCOC4_PEA_1_T12 (SEQ ID NO:23) | 4514 | 4577 |
| HSCOC4_PEA_1_T14 (SEQ ID NO:24) | 4514 | 4577 |
| HSCOC4_PEA_1_T15 (SEQ ID NO:25) | 4514 | 4577 |
| HSCOC4_PEA_1_T20 (SEQ ID NO:26) | 4596 | 4659 |
| HSCOC4_PEA_1_T21 (SEQ ID NO:27) | 4514 | 4577 |
| HSCOC4_PEA_1_T25 (SEQ ID NO:28) | 4514 | 4577 |
| HSCOC4_PEA_1_T28 (SEQ ID NO:29) | 4514 | 4577 |
| HSCOC4_PEA_1_T30 (SEQ ID NO:30) | 4514 | 4577 |
| HSCOC4_PEA_1_T31 (SEQ ID NO:31) | 4514 | 4577 |
| HSCOC4_PEA_1_T32 (SEQ ID NO:32) | 4514 | 4577 |

Segment cluster HSCOC4_PEA_1_node_78 (SEQ ID NO:198) according to the present invention is supported by 71 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T 11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA_1_T32 (SEQ ID NO:32). Table 260 below describes the starting and ending position of this segment on each transcript.

TABLE 260

Segment location on transcripts

| Transcript name | Segment starting position | Segment ending position |
|---|---|---|
| HSCOC4_PEA_1_T1 (SEQ ID NO:15) | 4691 | 4750 |
| HSCOC4_PEA_1_T2 (SEQ ID NO:16) | 4836 | 4895 |

TABLE 260-continued

Segment location on transcripts

| Transcript name | Segment starting position | Segment ending position |
|---|---|---|
| HSCOC4_PEA_1_T3 (SEQ ID NO:17) | 4949 | 5008 |
| HSCOC4_PEA_1_T4 (SEQ ID NO:18) | 4757 | 4816 |
| HSCOC4_PEA_1_T5 (SEQ ID NO:19) | 4677 | 4736 |
| HSCOC4_PEA_1_T7 (SEQ ID NO:20) | 4375 | 4434 |
| HSCOC4_PEA_1_T8 (SEQ ID NO:21) | 4578 | 4637 |
| HSCOC4_PEA_1_T11 (SEQ ID NO:22) | 4578 | 4637 |
| HSCOC4_PEA_1_T12 (SEQ ID NO:23) | 4578 | 4637 |
| HSCOC4_PEA_1_T14 (SEQ ID NO:24) | 4971 | 5030 |
| HSCOC4_PEA_1_T15 (SEQ ID NO:25) | 4578 | 4637 |
| HSCOC4_PEA_1_T20 (SEQ ID NO:26) | 5053 | 5112 |
| HSCOC4_PEA_1_T21 (SEQ ID NO:27) | 4578 | 4637 |
| HSCOC4_PEA_1_T25 (SEQ ID NO:28) | 4578 | 4637 |
| HSCOC4_PEA_1_T28 (SEQ ID NO:29) | 4578 | 4637 |
| HSCOC4_PEA_1_T30 (SEQ ID NO:30) | 4578 | 4637 |
| HSCOC4_PEA_1_T31 (SEQ ID NO:31) | 4578 | 4637 |
| HSCOC4_PEA_1_T32 (SEQ ID NO:32) | 4578 | 4637 |

Segment cluster HSCOC4_PEA_1_node_80 (SEQ ID NO:199) according to the present invention is supported by 75 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23) HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27) HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA_1_T32 (SEQ ID NO:32). Table 261 below describes the starting and ending position of this segment on each transcript.

TABLE 261

Segment location on transcripts

| Transcript name | Segment starting position | Segment ending position |
|---|---|---|
| HSCOC4_PEA_1_T1 (SEQ ID NO:15) | 4751 | 4844 |
| HSCOC4_PEA_1_T2 (SEQ ID NO:16) | 4896 | 4989 |
| HSCOC4_PEA_1_T3 (SEQ ID NO:17) | 5009 | 5102 |

TABLE 261-continued

Segment location on transcripts

| Transcript name | Segment starting position | Segment ending position |
|---|---|---|
| HSCOC4_PEA_1_T4 (SEQ ID NO:18) | 4817 | 4910 |
| HSCOC4_PEA_1_T5 (SEQ ID NO:19) | 4737 | 4830 |
| HSCOC4_PEA_1_T7 (SEQ ID NO:20) | 4435 | 4528 |
| HSCOC4_PEA_1_T8 (SEQ ID NO:21) | 4638 | 4731 |
| HSCOC4_PEA_1_T11 (SEQ ID NO:22) | 5687 | 5780 |
| HSCOC4_PEA_1_T12 (SEQ ID NO:23) | 4638 | 4731 |
| HSCOC4_PEA_1_T14 (SEQ ID NO:24) | 5031 | 5124 |
| HSCOC4_PEA_1_T15 (SEQ ID NO:25) | 4638 | 4731 |
| HSCOC4_PEA_1_T20 (SEQ ID NO:26) | 5113 | 5206 |
| HSCOC4_PEA_1_T21 (SEQ ID NO:27) | 4638 | 4731 |
| HSCOC4_PEA_1_T25 (SEQ ID NO:28) | 4638 | 4731 |
| HSCOC4_PEA_1_T28 (SEQ ID NO:29) | 4638 | 4731 |
| HSCOC4_PEA_1_T30 (SEQ ID NO:30) | 4638 | 4731 |
| HSCOC4_PEA_1_T31 (SEQ ID NO:31) | 4638 | 4731 |
| HSCOC4_PEA_1_T32 (SEQ ID NO:32) | 4638 | 4731 |

Segment cluster HSCOC4_PEA_1_node_82 (SEQ ID NO:200) according to the present invention can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA_1_T32 (SEQ ID NO:32). Table 262 below describes the starting and ending position of this segment on each transcript.

TABLE 262

Segment location on transcripts

| Transcript name | Segment starting position | Segment ending position |
|---|---|---|
| HSCOC4_PEA_1_T1 (SEQ ID NO:15) | 4845 | 4855 |
| HSCOC4_PEA_1_T2 (SEQ ID NO:16) | 4990 | 5000 |
| HSCOC4_PEA_1_T3 (SEQ ID NO:17) | 5103 | 5113 |
| HSCOC4_PEA_1_T4 (SEQ ID NO:18) | 4911 | 4921 |
| HSCOC4_PEA_1_T5 (SEQ ID NO:19) | 4831 | 4841 |

TABLE 262-continued

Segment location on transcripts

| Transcript name | Segment starting position | Segment ending position |
|---|---|---|
| HSCOC4_PEA_1_T7 (SEQ ID NO:20) | 4529 | 4539 |
| HSCOC4_PEA_1_T8 (SEQ ID NO:21) | 4732 | 4742 |
| HSCOC4_PEA_1_T11 (SEQ ID NO:22) | 5781 | 5791 |
| HSCOC4_PEA_1_T12 (SEQ ID NO:23) | 4732 | 4742 |
| HSCOC4_PEA_1_T14 (SEQ ID NO:24) | 5125 | 5135 |
| HSCOC4_PEA_1_T15 (SEQ ID NO:25) | 4732 | 4742 |
| HSCOC4_PEA_1_T20 (SEQ ID NO:26) | 5207 | 5217 |
| HSCOC4_PEA_1_T21 (SEQ ID NO:27) | 4732 | 4742 |
| HSCOC4_PEA_1_T25 (SEQ ID NO:28) | 4732 | 4742 |
| HSCOC4_PEA_1_T28 (SEQ ID NO:29) | 4732 | 4742 |
| HSCOC4_PEA_1_T30 (SEQ ID NO:30) | 4732 | 4742 |
| HSCOC4_PEA_1_T31 (SEQ ID NO:31) | 4732 | 4742 |
| HSCOC4_PEA_1_T32 (SEQ ID NO:32) | 4732 | 4742 |

Segment cluster HSCOC4_PEA_1_node_83 (SEQ ID NO:201) according to the present invention is supported by 77 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19) HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23) HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27) HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA_1_T32 (SEQ ID NO:32). Table 263 below describes the starting and ending position of this segment on each transcript.

TABLE 263

Segment location on transcripts

| Transcript name | Segment starting position | Segment ending position |
|---|---|---|
| HSCOC4_PEA_1_T1 (SEQ ID NO:15) | 4856 | 4971 |
| HSCOC4_PEA_1_T2 (SEQ ID NO:16) | 5001 | 5116 |
| HSCOC4_PEA_1_T3 (SEQ ID NO:17) | 5114 | 5229 |
| HSCOC4_PEA_1_T4 (SEQ ID NO:18) | 4922 | 5037 |
| HSCOC4_PEA_1_T5 (SEQ ID NO:19) | 4842 | 4957 |
| HSCOC4_PEA_1_T7 (SEQ ID NO:20) | 4540 | 4655 |

TABLE 263-continued

Segment location on transcripts

| Transcript name | Segment starting position | Segment ending position |
|---|---|---|
| HSCOC4_PEA_1_T8 (SEQ ID NO:21) | 4743 | 4858 |
| HSCOC4_PEA_1_T11 (SEQ ID NO:22) | 5792 | 5907 |
| HSCOC4_PEA_1_T12 (SEQ ID NO:23) | 4743 | 4858 |
| HSCOC4_PEA_1_T14 (SEQ ID NO:24) | 5136 | 5251 |
| HSCOC4_PEA_1_T15 (SEQ ID NO:25) | 4743 | 4858 |
| HSCOC4_PEA_1_T20 (SEQ ID NO:26) | 5218 | 5333 |
| HSCOC4_PEA_1_T21 (SEQ ID NO:27) | 4743 | 4858 |
| HSCOC4_PEA_1_T25 (SEQ ID NO:28) | 4743 | 4858 |
| HSCOC4_PEA_1_T28 (SEQ ID NO:29) | 4743 | 4858 |
| HSCOC4_PEA_1_T30 (SEQ ID NO:30) | 4743 | 4858 |
| HSCOC4_PEA_1_T31 (SEQ ID NO:31) | 4743 | 4858 |
| HSCOC4_PEA_1_T32 (SEQ ID NO:32) | 4743 | 4858 |

Segment cluster HSCOC4_PEA_1_node_84 (SEQ ID NO:202) according to the present invention can be found in the following transcript(s): HSCOC4_PEA_1_T1 (SEQ ID NO:15), HSCOC4_PEA_1_T2 (SEQ ID NO:16), HSCOC4 PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4 PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA_1_T32 (SEQ ID NO:32). Table 264 below describes the starting and ending position of this segment on each transcript.

TABLE 264

Segment location on transcripts

| Transcript name | Segment starting position | Segment ending position |
|---|---|---|
| HSCOC4_PEA_1_T1 (SEQ ID NO:15) | 4972 | 4984 |
| HSCOC4_PEA_1_T2 (SEQ ID NO:16) | 5117 | 5129 |
| HSCOC4_PEA_1_T3 (SEQ ID NO:17) | 5230 | 5242 |
| HSCOC4_PEA_1_T4 (SEQ ID NO:18) | 5038 | 5050 |
| HSCOC4_PEA_1_T5 (SEQ ID NO:19) | 4958 | 4970 |
| HSCOC4_PEA_1_T7 (SEQ ID NO:20) | 4656 | 4668 |
| HSCOC4_PEA_1_T8 (SEQ ID NO:21) | 4859 | 4871 |
| HSCOC4_PEA_1_T11 (SEQ ID NO:22) | 5908 | 5920 |

TABLE 264-continued

Segment location on transcripts

| Transcript name | Segment starting position | Segment ending position |
|---|---|---|
| HSCOC4_PEA_1_T12 (SEQ ID NO:23) | 4859 | 4871 |
| HSCOC4_PEA_1_T14 (SEQ ID NO:24) | 5252 | 5264 |
| HSCOC4_PEA_1_T15 (SEQ ID NO:25) | 4859 | 4871 |
| HSCOC4_PEA_1_T20 (SEQ ID NO:26) | 5334 | 5346 |
| HSCOC4_PEA_1_T21 (SEQ ID NO:27) | 4859 | 4871 |
| HSCOC4_PEA_1_T25 (SEQ ID NO:28) | 4859 | 4871 |
| HSCOC4_PEA_1_T28 (SEQ ID NO:29) | 4859 | 4871 |
| HSCOC4_PEA_1_T30 (SEQ ID NO:30) | 4859 | 4871 |
| HSCOC4_PEA_1_T31 (SEQ ID NO:31) | 4859 | 4871 |
| HSCOC4_PEA_1_T32 (SEQ ID NO:32) | 4859 | 4871 |

Segment cluster HSCOC4_PEA_1_node_85 (SEQ ID NO:203) according to the present invention is supported by 68 libraries. The number of libraries was determined as previously described. This segment can be found in the following transcript(s): HSCOC4_PEA_1_T1 (SEQ ID NO:15), HSCOC4 PEA_1_T2 (SEQ ID NO:16), HSCOC4_PEA 1 T3 (SEQ ID NO:17), HSCOC4_PEA_1_T4 (SEQ ID NO:18), HSCOC4 PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T20 (SEQ ID NO:26), HSCOC4_PEA_1_T21 (SEQ ID NO:27), HSCOC4 PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA_1_T32 (SEQ ID NO:32). Table 265 below describes the starting and ending position of this segment on each transcript.

TABLE 265

Segment location on transcripts

| Transcript name | Segment starting position | Segment ending position |
|---|---|---|
| HSCOC4_PEA_1_T1 (SEQ ID NO:15) | 4985 | 5031 |
| HSCOC4_PEA_1_T2 (SEQ ID NO:16) | 5130 | 5176 |
| HSCOC4_PEA_1_T3 (SEQ ID NO:17) | 5243 | 5289 |
| HSCOC4_PEA_1_T4 (SEQ ID NO:18) | 5051 | 5097 |
| HSCOC4_PEA_1_T5 (SEQ ID NO:19) | 4971 | 5017 |
| HSCOC4_PEA_1_T7 (SEQ ID NO:20) | 4669 | 4715 |
| HSCOC4_PEA_1_T8 (SEQ ID NO:21) | 4872 | 4918 |
| HSCOC4_PEA_1_T11 (SEQ ID NO:22) | 5921 | 5967 |
| HSCOC4_PEA_1_T12 (SEQ ID NO:23) | 4872 | 4918 |
| HSCOC4_PEA_1_T14 (SEQ ID NO:24) | 5265 | 5311 |
| HSCOC4_PEA_1_T20 (SEQ ID NO:26) | 5347 | 5393 |
| HSCOC4_PEA_1_T21 (SEQ ID NO:27) | 4872 | 4918 |
| HSCOC4_PEA_1_T25 (SEQ ID NO:28) | 4872 | 4918 |
| HSCOC4_PEA_1_T28 (SEQ ID NO:29) | 4872 | 4918 |
| HSCOC4_PEA_1_T30 (SEQ ID NO:30) | 4872 | 4918 |
| HSCOC4_PEA_1_T31 (SEQ ID NO:31) | 4872 | 4918 |
| HSCOC4_PEA_1_T32 (SEQ ID NO:32) | 4872 | 4918 |

Segment cluster HSCOC4_PEA_1_node_86 (SEQ ID NO:204) according to the present invention is supported by 7 libraries. The number of libraries was determined as previously described. This segment can be found in the following transcript(s): HSCOC4_PEA_1_T12 (SEQ ID NO:23). Table 266 below describes the starting and ending position of this segment on each transcript.

TABLE 266

Segment location on transcripts

| Transcript name | Segment starting position | Segment ending position |
|---|---|---|
| HSCOC4_PEA_1_T12 (SEQ ID NO:23) | 4919 | 5032 |

Segment cluster HSCOC4_PEA_1_node_87 (SEQ ID NO:205) according to the present invention is supported by 74 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23) HSCOC4_PEA_1_T14 (SEQ ID NO:24), HSCOC4_PEA_1_T15 (SEQ ID NO:25), HSCOC4_PEA_1_T20 (SEQ ID NO:261, HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA_1_T32 (SEQ ID NO:32). Table 267 below describes the starting and ending position of this segment on each transcript.

TABLE 267

Segment location on transcripts

| Transcript name | Segment starting position | Segment ending position |
|---|---|---|
| HSCOC4_PEA_1_T1 (SEQ ID NO:15) | 5032 | 5122 |
| HSCOC4_PEA_1_T2 (SEQ ID NO:16) | 5177 | 5267 |

TABLE 267-continued

Segment location on transcripts

| Transcript name | Segment starting position | Segment ending position |
| --- | --- | --- |
| HSCOC4_PEA_1_T3 (SEQ ID NO:17) | 5290 | 5380 |
| HSCOC4_PEA_1_T4 (SEQ ID NO:18) | 5098 | 5188 |
| HSCOC4_PEA_1_T5 (SEQ ID NO:19) | 5018 | 5108 |
| HSCOC4_PEA_1_T7 (SEQ ID NO:20) | 4716 | 4806 |
| HSCOC4_PEA_1_T8 (SEQ ID NO:21) | 4919 | 5009 |
| HSCOC4_PEA_1_T11 (SEQ ID NO:22) | 5968 | 6058 |
| HSCOC4_PEA_1_T12 (SEQ ID NO:23) | 5033 | 5123 |
| HSCOC4_PEA_1_T14 (SEQ ID NO:24) | 5312 | 5402 |
| HSCOC4_PEA_1_T15 (SEQ ID NO:25) | 4872 | 4962 |
| HSCOC4_PEA_1_T20 (SEQ ID NO:26) | 5394 | 5484 |
| HSCOC4_PEA_1_T21 (SEQ ID NO:27) | 4919 | 5009 |
| HSCOC4_PEA_1_T25 (SEQ ID NO:28) | 4919 | 5009 |
| HSCOC4_PEA_1_T28 (SEQ ID NO:29) | 4919 | 5009 |
| HSCOC4_PEA_1_T30 (SEQ ID NO:30) | 4919 | 5009 |
| HSCOC4_PEA_1_T31 (SEQ ID NO:31) | 4919 | 5009 |
| HSCOC4_PEA_1_T32 (SEQ ID NO:32) | 4919 | 5009 |

Segment cluster HSCOC4_PEA_1_node_88 (SEQ ID NO:206) according to the present invention is supported by 2 libraries. The number of libraries was determined as previously described. This segment can be found in the following transcript(s): HSCOC4_PEA_1_T12 (SEQ ID NO:23). Table 268 below describes the starting and ending position of this segment on each transcript.

TABLE 268

Segment location on transcripts

| Transcript name | Segment starting position | Segment ending position |
| --- | --- | --- |
| HSCOC4_PEA_1_T12 (SEQ ID NO:23) | 5124 | 5213 |

Segment cluster HSCOC4_PEA_1_node_89 (SEQ ID NO:207) according to the present invention can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17) HSCOC4_PEA_1_T4 (SEQ ID NO:18), HSCOC4_PEA_1_T5 (SEQ ID NO:19) HSCOC4_PEA_1_T7 (SEQ ID NO:20), HSCOC4_PEA_1_T8 (SEQ ID NO:21) HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25) HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29) HSCOC4_PEA_1_T30 (SEQ ID NO:30), HSCOC4_PEA_1_T31 (SEQ ID NO:31) and HSCOC4_PEA_1_T32 (SEQ ID NO:32). Table 269 below describes the starting and ending position of this segment on each transcript.

TABLE 269

Segment location on transcripts

| Transcript name | Segment starting position | Segment ending position |
| --- | --- | --- |
| HSCOC4_PEA_1_T1 (SEQ ID NO:15) | 5123 | 5131 |
| HSCOC4_PEA_1_T2 (SEQ ID NO:16) | 5268 | 5276 |
| HSCOC4_PEA_1_T3 (SEQ ID NO:17) | 5381 | 5389 |
| HSCOC4_PEA_1_T4 (SEQ ID NO:18) | 5189 | 5197 |
| HSCOC4_PEA_1_T5 (SEQ ID NO:19) | 5109 | 5117 |
| HSCOC4_PEA_1_T7 (SEQ ID NO:20) | 4807 | 4815 |
| HSCOC4_PEA_1_T8 (SEQ ID NO:21) | 5010 | 5018 |
| HSCOC4_PEA_1_T11 (SEQ ID NO:22) | 6059 | 6067 |
| HSCOC4_PEA_1_T12 (SEQ ID NO:23) | 5214 | 5222 |
| HSCOC4_PEA_1_T14 (SEQ ID NO:24) | 5403 | 5411 |
| HSCOC4_PEA_1_T15 (SEQ ID NO:25) | 4963 | 4971 |
| HSCOC4_PEA_1_T20 (SEQ ID NO:26) | 5485 | 5493 |
| HSCOC4_PEA_1_T21 (SEQ ID NO:27) | 5010 | 5018 |
| HSCOC4_PEA_1_T25 (SEQ ID NO:28) | 5010 | 5018 |
| HSCOC4_PEA_1_T28 (SEQ ID NO:29) | 5010 | 5018 |
| HSCOC4_PEA_1_T30 (SEQ ID NO:30) | 5010 | 5018 |
| HSCOC4_PEA_1_T31 (SEQ ID NO:31) | 5010 | 5018 |
| HSCOC4_PEA_1_T32 (SEQ ID NO:32) | 5010 | 5018 |

Segment cluster HSCOC4_PEA_1_node_90 (SEQ ID NO:208) according to the present invention can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA_1_T32 (SEQ ID NO:32). Table 270 below describes the starting and ending position of this segment on each transcript.

TABLE 270

Segment location on transcripts

| Transcript name | Segment starting position | Segment ending position |
| --- | --- | --- |
| HSCOC4_PEA_1_T1 (SEQ ID NO:15) | 5132 | 5142 |

TABLE 270-continued

Segment location on transcripts

| Transcript name | Segment starting position | Segment ending position |
|---|---|---|
| HSCOC4_PEA_1_T2 (SEQ ID NO:16) | 5277 | 5287 |
| HSCOC4_PEA_1_T3 (SEQ ID NO:17) | 5390 | 5400 |
| HSCOC4_PEA_1_T4 (SEQ ID NO:18) | 5198 | 5208 |
| HSCOC4_PEA_1_T5 (SEQ ID NO:19) | 5118 | 5128 |
| HSCOC4_PEA_1_T7 (SEQ ID NO:20) | 4816 | 4826 |
| HSCOC4_PEA_1_T8 (SEQ ID NO:21) | 5019 | 5029 |
| HSCOC4_PEA_1_T11 (SEQ ID NO:22) | 6068 | 6078 |
| HSCOC4_PEA_1_T12 (SEQ ID NO:23) | 5223 | 5233 |
| HSCOC4_PEA_1_T14 (SEQ ID NO:24) | 5412 | 5422 |
| HSCOC4_PEA_1_T15 (SEQ ID NO:25) | 4972 | 4982 |
| HSCOC4_PEA_1_T20 (SEQ ID NO:26) | 5494 | 5504 |
| HSCOC4_PEA_1_T21 (SEQ ID NO:27) | 5019 | 5029 |
| HSCOC4_PEA_1_T25 (SEQ ID NO:28) | 5019 | 5029 |
| HSCOC4_PEA_1_T28 (SEQ ID NO:29) | 5019 | 5029 |
| HSCOC4_PEA_1_T30 (SEQ ID NO:30) | 5019 | 5029 |
| HSCOC4_PEA_1_T31 (SEQ ID NO:31) | 5019 | 5029 |
| HSCOC4_PEA_1_T32 (SEQ ID NO:32) | 5019 | 5029 |

Segment cluster HSCOC4_PEA_1_node_91 (SEQ ID NO:209) according to the present invention is supported by 78 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19) HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA_1_T32 (SEQ ID NO:32). Table 271 below describes the starting and ending position of this segment on each transcript.

TABLE 271

Segment location on transcripts

| Transcript name | Segment starting position | Segment ending position |
|---|---|---|
| HSCOC4_PEA_1_T1 (SEQ ID NO:15) | 5143 | 5179 |
| HSCOC4_PEA_1_T2 (SEQ ID NO:16) | 5288 | 5324 |

TABLE 271-continued

Segment location on transcripts

| Transcript name | Segment starting position | Segment ending position |
|---|---|---|
| HSCOC4_PEA_1_T3 (SEQ ID NO:17) | 5401 | 5437 |
| HSCOC4_PEA_1_T4 (SEQ ID NO:18) | 5209 | 5245 |
| HSCOC4_PEA_1_T5 (SEQ ID NO:19) | 5129 | 5165 |
| HSCOC4_PEA_1_T7 (SEQ ID NO:20) | 4827 | 4863 |
| HSCOC4_PEA_1_T8 (SEQ ID NO:21) | 5030 | 5066 |
| HSCOC4_PEA_1_T11 (SEQ ID NO:22) | 6079 | 6115 |
| HSCOC4_PEA_1_T12 (SEQ ID NO:23) | 5234 | 5270 |
| HSCOC4_PEA_1_T14 (SEQ ID NO:24) | 5423 | 5459 |
| HSCOC4_PEA_1_T15 (SEQ ID NO:25) | 4983 | 5019 |
| HSCOC4_PEA_1_T20 (SEQ ID NO:26) | 5505 | 5541 |
| HSCOC4_PEA_1_T21 (SEQ ID NO:27) | 5030 | 5066 |
| HSCOC4_PEA_1_T25 (SEQ ID NO:28) | 5030 | 5066 |
| HSCOC4_PEA_1_T28 (SEQ ID NO:29) | 5030 | 5066 |
| HSCOC4_PEA_1_T30 (SEQ ID NO:30) | 5030 | 5066 |
| HSCOC4_PEA_1_T31 (SEQ ID NO:31) | 5030 | 5066 |
| HSCOC4_PEA_1_T32 (SEQ ID NO:32) | 5030 | 5066 |

Segment cluster HSCOC4_PEA_1_node_92 (SEQ ID NO:210) according to the present invention can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:231 HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31) and HSCOC4_PEA_1_T32 (SEQ ID NO:32). Table 272 below describes the starting and ending position of this segment on each transcript.

TABLE 272

Segment location on transcripts

| Transcript name | Segment starting position | Segment ending position |
|---|---|---|
| HSCOC4_PEA_1_T1 (SEQ ID NO:15) | 5180 | 5197 |
| HSCOC4_PEA_1_T2 (SEQ ID NO:16) | 5325 | 5342 |
| HSCOC4_PEA_1_T3 (SEQ ID NO:17) | 5438 | 5455 |
| HSCOC4_PEA_1_T4 (SEQ ID NO:18) | 5246 | 5263 |

TABLE 272-continued

Segment location on transcripts

| Transcript name | Segment starting position | Segment ending position |
|---|---|---|
| HSCOC4_PEA_1_T5 (SEQ ID NO:19) | 5166 | 5183 |
| HSCOC4_PEA_1_T7 (SEQ ID NO:20) | 4864 | 4881 |
| HSCOC4_PEA_1_T8 (SEQ ID NO:21) | 5067 | 5084 |
| HSCOC4_PEA_1_T11 (SEQ ID NO:22) | 6116 | 6133 |
| HSCOC4_PEA_1_T12 (SEQ ID NO:23) | 5271 | 5288 |
| HSCOC4_PEA_1_T14 (SEQ ID NO:24) | 5460 | 5477 |
| HSCOC4_PEA_1_T15 (SEQ ID NO:25) | 5020 | 5037 |
| HSCOC4_PEA_1_T20 (SEQ ID NO:26) | 5542 | 5559 |
| HSCOC4_PEA_1_T21 (SEQ ID NO:27) | 5067 | 5084 |
| HSCOC4_PEA_1_T25 (SEQ ID NO:28) | 5067 | 5084 |
| HSCOC4_PEA_1_T28 (SEQ ID NO:29) | 5067 | 5084 |
| HSCOC4_PEA_1_T30 (SEQ ID NO:30) | 5067 | 5084 |
| HSCOC4_PEA_1_T31 (SEQ ID NO:31) | 5067 | 5084 |
| HSCOC4_PEA_1_T32 (SEQ ID NO:32) | 5067 | 5084 |

Segment cluster HSCOC4_PEA_1_node_94 (SEQ ID NO:211) according to the present invention can be found in the following transcript(s): HSCOC4_PEA_1_T8 (SEQ ID NO:21), HSCOC4_PEA_1_T12 (SEQ ID NO:23) and HSCOC4_PEA_1_T21 (SEQ ID NO:27). Table 273 below describes the starting and ending position of this segment on each transcript.

TABLE 273

Segment location on transcripts

| Transcript name | Segment starting position | Segment ending position |
|---|---|---|
| HSCOC4_PEA_1_T8 (SEQ ID NO:21) | 6567 | 6575 |
| HSCOC4_PEA_1_T12 (SEQ ID NO:23) | 6771 | 6779 |
| HSCOC4_PEA_1_T21 (SEQ ID NO:27) | 6567 | 6575 |

Segment cluster HSCOC4_PEA_1_node_96 (SEQ ID NO:212) according to the present invention can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T31 (SEQ ID NO:31) and HSCOC4_PEA_1_T32 (SEQ ID NO:32). Table 274 below describes the starting and ending position of this segment on each transcript.

TABLE 274

Segment location on transcripts

| Transcript name | Segment starting position | Segment ending position |
|---|---|---|
| HSCOC4_PEA_1_T1 (SEQ ID NO:15) | 5198 | 5205 |
| HSCOC4_PEA_1_T2 (SEQ ID NO:16) | 5343 | 5350 |
| HSCOC4_PEA_1_T3 (SEQ ID NO:17) | 5456 | 5463 |
| HSCOC4_PEA_1_T4 (SEQ ID NO:18) | 5264 | 5271 |
| HSCOC4_PEA_1_T5 (SEQ ID NO:19) | 5184 | 5191 |
| HSCOC4_PEA_1_T7 (SEQ ID NO:20) | 4882 | 4889 |
| HSCOC4_PEA_1_T8 (SEQ ID NO:21) | 6576 | 6583 |
| HSCOC4_PEA_1_T11 (SEQ ID NO:22) | 6134 | 6141 |
| HSCOC4_PEA_1_T12 (SEQ ID NO:23) | 6780 | 6787 |
| HSCOC4_PEA_1_T14 (SEQ ID NO:24) | 5478 | 5485 |
| HSCOC4_PEA_1_T15 (SEQ ID NO:25) | 5038 | 5045 |
| HSCOC4_PEA_1_T20 (SEQ ID NO:26) | 5560 | 5567 |
| HSCOC4_PEA_1_T21 (SEQ ID NO:27) | 6576 | 6583 |
| HSCOC4_PEA_1_T25 (SEQ ID NO:28) | 5085 | 5092 |
| HSCOC4_PEA_1_T28 (SEQ ID NO:29) | 5085 | 5092 |
| HSCOC4_PEA_1_T31 (SEQ ID NO:31) | 5085 | 5092 |
| HSCOC4_PEA_1_T32 (SEQ ID NO:32) | 5085 | 5092 |

Segment cluster HSCOC4_PEA_1_node_97 (SEQ ID NO:213) according to the present invention can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23) HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T31 (SEQ ID NO:31) and HSCOC4_PEA_1_T32 (SEQ ID NO:32). Table 275 below describes the starting and ending position of this segment on each transcript.

TABLE 275

Segment location on transcripts

| Transcript name | Segment starting position | Segment ending position |
|---|---|---|
| HSCOC4_PEA_1_T1 (SEQ ID NO:15) | 5206 | 5222 |
| HSCOC4_PEA_1_T2 (SEQ ID NO:16) | 5351 | 5367 |
| HSCOC4_PEA_1_T3 (SEQ ID NO:17) | 5464 | 5480 |

TABLE 275-continued

Segment location on transcripts

| Transcript name | Segment starting position | Segment ending position |
|---|---|---|
| HSCOC4_PEA_1_T4 (SEQ ID NO:18) | 5272 | 5288 |
| HSCOC4_PEA_1_T5 (SEQ ID NO:19) | 5192 | 5208 |
| HSCOC4_PEA_1_T7 (SEQ ID NO:20) | 4890 | 4906 |
| HSCOC4_PEA_1_T8 (SEQ ID NO:21) | 6584 | 6600 |
| HSCOC4_PEA_1_T11 (SEQ ID NO:22) | 6142 | 6158 |
| HSCOC4_PEA_1_T12 (SEQ ID NO:23) | 6788 | 6804 |
| HSCOC4_PEA_1_T14 (SEQ ID NO:24) | 5486 | 5502 |
| HSCOC4_PEA_1_T15 (SEQ ID NO:25) | 5046 | 5062 |
| HSCOC4_PEA_1_T20 (SEQ ID NO:26) | 5568 | 5584 |
| HSCOC4_PEA_1_T21 (SEQ ID NO:27) | 6584 | 6600 |
| HSCOC4_PEA_1_T25 (SEQ ID NO:28) | 5093 | 5109 |
| HSCOC4_PEA_1_T28 (SEQ ID NO:29) | 5093 | 5109 |
| HSCOC4_PEA_1_T31 (SEQ ID NO:31) | 5093 | 5109 |
| HSCOC4_PEA_1_T32 (SEQ ID NO:32) | 5093 | 5109 |

Segment cluster HSCOC4_PEA_1_node_98 (SEQ ID NO:214) according to the present invention is supported by 93 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T31 (SEQ ID NO:31) and HSCOC4_PEA_1_T32 (SEQ ID NO:32). Table 276 below describes the starting and ending position of this segment on each transcript.

TABLE 276

Segment location on transcripts

| Transcript name | Segment starting position | Segment ending position |
|---|---|---|
| HSCOC4_PEA_1_T1 (SEQ ID NO:15) | 5223 | 5271 |
| HSCOC4_PEA_1_T2 (SEQ ID NO:16) | 5368 | 5416 |
| HSCOC4_PEA_1_T3 (SEQ ID NO:17) | 5481 | 5529 |
| HSCOC4_PEA_1_T4 (SEQ ID NO:18) | 5289 | 5337 |
| HSCOC4_PEA_1_T5 (SEQ ID NO:19) | 5209 | 5257 |
| HSCOC4_PEA_1_T7 (SEQ ID NO:20) | 4907 | 4955 |
| HSCOC4_PEA_1_T8 (SEQ ID NO:21) | 6601 | 6649 |
| HSCOC4_PEA_1_T11 (SEQ ID NO:22) | 6159 | 6207 |
| HSCOC4_PEA_1_T12 (SEQ ID NO:23) | 6805 | 6853 |
| HSCOC4_PEA_1_T14 (SEQ ID NO:24) | 5503 | 5551 |
| HSCOC4_PEA_1_T15 (SEQ ID NO:25) | 5063 | 5111 |
| HSCOC4_PEA_1_T20 (SEQ ID NO:26) | 5585 | 5633 |
| HSCOC4_PEA_1_T21 (SEQ ID NO:27) | 6601 | 6649 |
| HSCOC4_PEA_1_T25 (SEQ ID NO:28) | 5110 | 5158 |
| HSCOC4_PEA_1_T28 (SEQ ID NO:29) | 5110 | 5158 |
| HSCOC4_PEA_1_T31 (SEQ ID NO:31) | 5110 | 5158 |
| HSCOC4_PEA_1_T32 (SEQ ID NO:32) | 5110 | 5158 |

Segment cluster HSCOC4_PEA_1_node_99 (SEQ ID NO:215) according to the present invention is supported by 93 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23) HSCOC4_PEA_1_T14 (SEQ ID NO:24), HSCOC4_PEA_1_T15 (SEQ ID NO:25) HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T31 (SEQ ID NO:31), HSCOC4_PEA_1_T32 (SEQ ID NO:32) and HSCOC4_PEA_1_T40 (SEQ ID NO:33). Table 277 below describes the starting and ending position of this segment on each transcript.

TABLE 277

Segment location on transcripts

| Transcript name | Segment starting position | Segment ending position |
|---|---|---|
| HSCOC4_PEA_1_T1 (SEQ ID NO:15) | 5272 | 5300 |
| HSCOC4_PEA_1_T2 (SEQ ID NO:16) | 5417 | 5445 |
| HSCOC4_PEA_1_T3 (SEQ ID NO:17) | 5530 | 5558 |
| HSCOC4_PEA_1_T4 (SEQ ID NO:18) | 5338 | 5366 |
| HSCOC4_PEA_1_T5 (SEQ ID NO:19) | 5258 | 5286 |
| HSCOC4_PEA_1_T7 (SEQ ID NO:20) | 4956 | 4984 |
| HSCOC4_PEA_1_T8 (SEQ ID NO:21) | 6650 | 6678 |
| HSCOC4_PEA_1_T11 (SEQ ID NO:22) | 6208 | 6236 |

TABLE 277-continued

Segment location on transcripts

| Transcript name | Segment starting position | Segment ending position |
|---|---|---|
| HSCOC4_PEA_1_T12 (SEQ ID NO:23) | 6854 | 6882 |
| HSCOC4_PEA_1_T14 (SEQ ID NO:24) | 5552 | 5580 |
| HSCOC4_PEA_1_T15 (SEQ ID NO:25) | 5112 | 5140 |
| HSCOC4_PEA_1_T20 (SEQ ID NO:26) | 5634 | 5662 |
| HSCOC4_PEA_1_T21 (SEQ ID NO:27) | 6650 | 6678 |
| HSCOC4_PEA_1_T25 (SEQ ID NO:28) | 5159 | 5187 |
| HSCOC4_PEA_1_T28 (SEQ ID NO:29) | 5159 | 5187 |
| HSCOC4_PEA_1_T31 (SEQ ID NO:31) | 5159 | 5187 |
| HSCOC4_PEA_1_T32 (SEQ ID NO:32) | 5159 | 5187 |
| HSCOC4_PEA_1_T40 (SEQ ID NO:33) | 4197 | 4225 |

Segment cluster HSCOC4_PEA_1_node_101 (SEQ ID NO:216) according to the present invention is supported by 116 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25) HSCOC4_PEA_1_T20 (SEQ ID NO:26), HSCOC4_PEA_1_T21 (SEQ ID NO:27) HSCOC4_PEA_1_T25 (SEQ ID NO:28), HSCOC4_PEA_1_T28 (SEQ ID NO:29) HSCOC4_PEA_1_T30 (SEQ ID NO:30), HSCOC4_PEA_1_T31 (SEQ ID NO:31) HSCOC4_PEA_1_T32 (SEQ ID NO:32) and HSCOC4_PEA_1_T40 (SEQ ID NO:33). Table 278 below describes the starting and ending position of this segment on each transcript.

TABLE 278

Segment location on transcripts

| Transcript name | Segment starting position | Segment ending position |
|---|---|---|
| HSCOC4_PEA_1_T1 (SEQ ID NO:15) | 5301 | 5390 |
| HSCOC4_PEA_1_T2 (SEQ ID NO:16) | 5446 | 5535 |
| HSCOC4_PEA_1_T3 (SEQ ID NO:17) | 5559 | 5648 |
| HSCOC4_PEA_1_T4 (SEQ ID NO:18) | 5367 | 5456 |
| HSCOC4_PEA_1_T5 (SEQ ID NO:19) | 5287 | 5376 |
| HSCOC4_PEA_1_T7 (SEQ ID NO:20) | 4985 | 5074 |
| HSCOC4_PEA_1_T8 (SEQ ID NO:21) | 6679 | 6768 |
| HSCOC4_PEA_1_T11 (SEQ ID NO:22) | 6237 | 6326 |

TABLE 278-continued

Segment location on transcripts

| Transcript name | Segment starting position | Segment ending position |
|---|---|---|
| HSCOC4_PEA_1_T12 (SEQ ID NO:23) | 6883 | 6972 |
| HSCOC4_PEA_1_T14 (SEQ ID NO:24) | 5581 | 5670 |
| HSCOC4_PEA_1_T15 (SEQ ID NO:25) | 5141 | 5230 |
| HSCOC4_PEA_1_T20 (SEQ ID NO:26) | 5663 | 5752 |
| HSCOC4_PEA_1_T21 (SEQ ID NO:27) | 6844 | 6933 |
| HSCOC4_PEA_1_T25 (SEQ ID NO:28) | 5188 | 5277 |
| HSCOC4_PEA_1_T28 (SEQ ID NO:29) | 5188 | 5277 |
| HSCOC4_PEA_1_T30 (SEQ ID NO:30) | 5085 | 5174 |
| HSCOC4_PEA_1_T31 (SEQ ID NO:31) | 5188 | 5277 |
| HSCOC4_PEA_1_T32 (SEQ ID NO:32) | 5188 | 5277 |
| HSCOC4_PEA_1_T40 (SEQ ID NO:33) | 4226 | 4315 |

Segment cluster HSCOC4_PEA_1_node_102 (SEQ ID NO:217) according to the present invention is supported by 3 libraries. The number of libraries was determined as previously described. This segment can be found in the following transcript(s): HSCOC4_PEA_1_T31 (SEQ ID NO:31) and HSCOC4_PEA_1_T32 (SEQ ID NO:32). Table 279 below describes the starting and ending position of this segment on each transcript.

TABLE 279

Segment location on transcripts

| Transcript name | Segment starting position | Segment ending position |
|---|---|---|
| HSCOC4_PEA_1_T31 (SEQ ID NO:31) | 5278 | 5362 |
| HSCOC4_PEA_1_T32 (SEQ ID NO:32) | 5278 | 5362 |

Segment cluster HSCOC4_PEA_1_node_103 (SEQ ID NO:218) according to the present invention is supported by 106 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19) HSCOC4_PEA_1_T7 (SEQ ID NO:20), HSCOC4_PEA_1_T8 (SEQ ID NO:21) HSCOC4_PEA_1_T11 (SEQ ID NO:22), HSCOC4_PEA_1_T12 (SEQ ID NO:23) HSCOC4_PEA_1_T14 (SEQ ID NO:24), HSCOC4_PEA_1_T15 (SEQ ID NO:25) HSCOC4_PEA_1_T20 (SEQ ID NO:26), HSCOC4_PEA_1_T21 (SEQ ID NO:27) HSCOC4_PEA_1_T25 (SEQ ID NO:28), HSCOC4_PEA_1_T28 (SEQ ID NO:29) HSCOC4_PEA_1_T30 (SEQ ID NO:30), HSCOC4_PEA_1_T31 (SEQ ID NO:31) HSCOC4_PEA_1_T32 (SEQ ID NO:32) and HSCOC4_PEA_1_T40 (SEQ ID NO:33). Table 280 below describes the starting and ending position of this segment on each transcript.

TABLE 280

Segment location on transcripts

| Transcript name | Segment starting position | Segment ending position |
|---|---|---|
| HSCOC4_PEA_1_T1 (SEQ ID NO:15) | 5391 | 5463 |
| HSCOC4_PEA_1_T2 (SEQ ID NO:16) | 5536 | 5608 |
| HSCOC4_PEA_1_T3 (SEQ ID NO:17) | 5649 | 5721 |
| HSCOC4_PEA_1_T4 (SEQ ID NO:18) | 5457 | 5529 |
| HSCOC4_PEA_1_T5 (SEQ ID NO:19) | 5377 | 5449 |
| HSCOC4_PEA_1_T7 (SEQ ID NO:20) | 5075 | 5147 |
| HSCOC4_PEA_1_T8 (SEQ ID NO:21) | 6769 | 6841 |
| HSCOC4_PEA_1_T11 (SEQ ID NO:22) | 6327 | 6399 |
| HSCOC4_PEA_1_T12 (SEQ ID NO:23) | 6973 | 7045 |
| HSCOC4_PEA_1_T14 (SEQ ID NO:24) | 5671 | 5743 |
| HSCOC4_PEA_1_T15 (SEQ ID NO:25) | 5231 | 5303 |
| HSCOC4_PEA_1_T20 (SEQ ID NO:26) | 5753 | 5825 |
| HSCOC4_PEA_1_T21 (SEQ ID NO:27) | 6934 | 7006 |
| HSCOC4_PEA_1_T25 (SEQ ID NO:28) | 5278 | 5350 |
| HSCOC4_PEA_1_T28 (SEQ ID NO:29) | 5278 | 5350 |
| HSCOC4_PEA_1_T30 (SEQ ID NO:30) | 5175 | 5247 |
| HSCOC4_PEA_1_T31 (SEQ ID NO:31) | 5363 | 5435 |
| HSCOC4_PEA_1_T32 (SEQ ID NO:32) | 5363 | 5435 |
| HSCOC4_PEA_1_T40 (SEQ ID NO:33) | 4316 | 4388 |

Segment cluster HSCOC4_PEA_1_node_104 (SEQ ID NO:219) according to the present invention is supported by 101 libraries. The number of libraries was determined as previously described. This segment can be found in the following transcript(s): HSCOC4 PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 281 below describes the starting and ending position of this segment on each transcript.

TABLE 281

Segment location on transcripts

| Transcript name | Segment starting position | Segment ending position |
|---|---|---|
| HSCOC4_PEA_1_T1 (SEQ ID NO:15) | 5464 | 5489 |
| HSCOC4_PEA_1_T2 (SEQ ID NO:16) | 5609 | 5634 |
| HSCOC4_PEA_1_T3 (SEQ ID NO:17) | 5722 | 5747 |
| HSCOC4_PEA_1_T4 (SEQ ID NO:18) | 5530 | 5555 |
| HSCOC4_PEA_1_T5 (SEQ ID NO:19) | 5450 | 5475 |
| HSCOC4_PEA_1_T7 (SEQ ID NO:20) | 5148 | 5173 |
| HSCOC4_PEA_1_T8 (SEQ ID NO:21) | 6842 | 6867 |
| HSCOC4_PEA_1_T11 (SEQ ID NO:22) | 6400 | 6425 |
| HSCOC4_PEA_1_T12 (SEQ ID NO:23) | 7046 | 7071 |
| HSCOC4_PEA_1_T14 (SEQ ID NO:24) | 5744 | 5769 |
| HSCOC4_PEA_1_T15 (SEQ ID NO:25) | 5304 | 5329 |
| HSCOC4_PEA_1_T20 (SEQ ID NO:26) | 5826 | 5851 |
| HSCOC4_PEA_1_T21 (SEQ ID NO:27) | 7007 | 7032 |
| HSCOC4_PEA_1_T25 (SEQ ID NO:28) | 5351 | 5376 |
| HSCOC4_PEA_1_T28 (SEQ ID NO:29) | 5351 | 5376 |
| HSCOC4_PEA_1_T30 (SEQ ID NO:30) | 5248 | 5273 |
| HSCOC4_PEA_1_T31 (SEQ ID NO:31) | 5436 | 5461 |
| HSCOC4_PEA_1_T32 (SEQ ID NO:32) | 5436 | 5461 |
| HSCOC4_PEA_1_T40 (SEQ ID NO:33) | 4389 | 4414 |

Segment cluster HSCOC4_PEA_1_node_106 (SEQ ID NO:220) according to the present invention is supported by 110 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 282 below describes the starting and ending position of this segment on each transcript.

TABLE 282

Segment location on transcripts

| Transcript name | Segment starting position | Segment ending position |
|---|---|---|
| HSCOC4_PEA_1_T1 (SEQ ID NO:15) | 5490 | 5573 |
| HSCOC4_PEA_1_T2 (SEQ ID NO:16) | 5635 | 5718 |
| HSCOC4_PEA_1_T3 (SEQ ID NO:17) | 5748 | 5831 |
| HSCOC4_PEA_1_T4 (SEQ ID NO:18) | 5556 | 5639 |
| HSCOC4_PEA_1_T5 (SEQ ID NO:19) | 5476 | 5559 |
| HSCOC4_PEA_1_T7 (SEQ ID NO:20) | 5174 | 5257 |
| HSCOC4_PEA_1_T8 (SEQ ID NO:21) | 6868 | 6951 |
| HSCOC4_PEA_1_T11 (SEQ ID NO:22) | 6426 | 6509 |
| HSCOC4_PEA_1_T12 (SEQ ID NO:23) | 7072 | 7155 |
| HSCOC4_PEA_1_T14 (SEQ ID NO:24) | 5770 | 5853 |
| HSCOC4_PEA 1_T15 (SEQ ID NO:25) | 5330 | 5413 |
| HSCOC4_PEA_1_T20 (SEQ ID NO:26) | 5852 | 5935 |
| HSCOC4_PEA_1_T21 (SEQ ID NO:27) | 7033 | 7116 |
| HSCOC4_PEA_1_T25 (SEQ ID NO:28) | 5377 | 5460 |
| HSCOC4_PEA_1_T28 (SEQ ID NO:29) | 5559 | 5642 |
| HSCOC4_PEA_1_T30 (SEQ ID NO:30) | 5274 | 5357 |
| HSCOC4_PEA_1_T31 (SEQ ID NO:31) | 5462 | 5545 |
| HSCOC4_PEA_1_T32 (SEQ ID NO:32) | 5644 | 5727 |
| HSCOC4_PEA_1_T40 (SEQ ID NO:33) | 4415 | 4498 |

Segment cluster HSCOC4_PEA_1_node_111 (SEQ ID NO:221) according to the present invention is supported by 77 libraries. The number of libraries was determined as previously described. This segment can be found in the following transcript(s): HSCOC4_PEA_1_T1 (SEQ ID NO:15), HSCOC4_PEA_1_T2 (SEQ ID NO:16), HSCOC4_PEA_1_T3 (SEQ ID NO:17), HSCOC4_PEA_1_T4 (SEQ ID NO:18), HSCOC4_PEA_1_T5 (SEQ ID NO:19), HSCOC4_PEA_1_T7 (SEQ ID NO:20), HSCOC4_PEA_1_T8 (SEQ ID NO:21), HSCOC4_PEA_1_T11 (SEQ ID NO:22), HSCOC4_PEA_1_T12 (SEQ ID NO:23), HSCOC4_PEA_1_T14 (SEQ ID NO:24), HSCOC4_PEA_1_T15 (SEQ ID NO:25), HSCOC4_PEA_1_T20 (SEQ ID NO:26), HSCOC4_PEA_1_T21 (SEQ ID NO:27), HSCOC4_PEA_1_T25 (SEQ ID NO:28), HSCOC4_PEA_1_T28 (SEQ ID NO:29), HSCOC4_PEA_1_T30 (SEQ ID NO:30), HSCOC4_PEA_1_T31 (SEQ ID NO:31), HSCOC4_PEA_1_T32 (SEQ ID NO:32) and HSCOC4_PEA_1_T40 (SEQ ID NO:33). Table 283 below describes the starting and ending position of this segment on each transcript.

TABLE 283

Segment location on transcripts

| Transcript name | Segment starting position | Segment ending position |
|---|---|---|
| HSCOC4_PEA_1_T1 (SEQ ID NO:15) | 5857 | 5947 |
| HSCOC4_PEA_1_T2 (SEQ ID NO:16) | 6002 | 6092 |
| HSCOC4_PEA_1_T3 (SEQ ID NO:17) | 6115 | 6205 |
| HSCOC4_PEA_1_T4 (SEQ ID NO:18) | 5923 | 6013 |
| HSCOC4_PEA_1_T5 (SEQ ID NO:19) | 5843 | 5933 |
| HSCOC4_PEA_1_T7 (SEQ ID NO:20) | 5541 | 5631 |
| HSCOC4_PEA_1_T8 (SEQ ID NO:21) | 7235 | 7325 |
| HSCOC4_PEA_1_T11 (SEQ ID NO:22) | 6793 | 6883 |
| HSCOC4_PEA_1_T12 (SEQ ID NO:23) | 7439 | 7529 |
| HSCOC4_PEA_1_T14 (SEQ ID NO:24) | 6137 | 6227 |
| HSCOC4_PEA_1_T15 (SEQ ID NO:25) | 5697 | 5787 |
| HSCOC4_PEA_1_T20 (SEQ ID NO:26) | 6219 | 6309 |
| HSCOC4_PEA_1_T21 (SEQ ID NO:27) | 7400 | 7490 |
| HSCOC4_PEA_1_T25 (SEQ ID NO:28) | 6149 | 6239 |
| HSCOC4_PEA_1_T28 (SEQ ID NO:29) | 6331 | 6421 |
| HSCOC4_PEA_1_T30 (SEQ ID NO:30) | 5641 | 5731 |
| HSCOC4_PEA_1_T31 (SEQ ID NO:31) | 5829 | 5919 |
| HSCOC4_PEA_1_T32 (SEQ ID NO:32) | 6273 | 6363 |
| HSCOC4_PEA_1_T40 (SEQ ID NO:33) | 4782 | 4872 |

Variant Protein Alignment to the Previously Known Protein:

Sequence name: CO4_HUMAN
Sequence documentation:
Alignment of: HSCOC4_PEA_1_P3 (SEQ ID NO:340) x CO4_HUMAN . . .
Alignment segment 1/1:
Quality: 8438.00
Escore: 0
Matching length: 870
Total length: 870
Matching Percent Similarity: 99.66
Matching Percent Identity: 99.66
Total Percent Similarity: 99.66
Total Percent Identity: 99.66
Gaps: 0
Alignment:

```
  1 MRLLWGLIWASSFFTLSLQKPRLLLFSPSVVHLGVPLSVGVQLQDVPRGQ  50
    |||||||||||||||||||||||||||||||||||||||||||||||||
  1 MRLLWGLIWASSFFTLSLQKPRLLLFSPSVVHLGVPLSVGVQLQDVPRGQ  50

51 VVKGSVFLRNPSRNNVPCSPKVDFTLSSERDFALLSLQVPLKDAKSCGLH 100
    |||||||||||||||||||||||||||||||||||||||||||||||||
 51 VVKGSVFLRNPSRNNVPCSPKVDFTLSSERDFALLSLQVPLKDAKSCGLH 100

101 QLLRGPEVQLVAHSPWLKDSLSRTTNIQGINLLFSSRRGHLFLQTDQPIY 150
    |||||||||||||||||||||||||||||||||||||||||||||||||
101 QLLRGPEVQLVAHSPWLKDSLSRTTNIQGINLLFSSRRGHLFLQTDQPIY 150

151 NPGQRVRYRVFALDQKMRPSTDTITVMVENSHGLRVRKKEVYMPSSIFQD 200
    |||||||||||||||||||||||||||||||||||||||||||||||||
151 NPGQRVRYRVFALDQKMRPSTDTITVMVENSHGLRVRKKEVYMPSSIFQD 200

201 DFVIPDISEPGTWKISARFSDGLESNSSTQFEVKKYVLPNFEVKITPGKP 250
    |||||||||||||||||||||||||||||||||||||||||||||||||
201 DFVIPDISEPGTWKISARFSDGLESNSSTQFEVKKYVLPNFEVKITPGKP 250

251 YILTVPGHLDEMQLDIQARYIYGKPVQGVAYVRFGLLDEDGKKTFFRGLE 300
    |||||||||||||||||||||||||||||||||||||||||||||||||
251 YILTVPGHLDEMQLDIQARYIYGKPVQGVAYVRFGLLDEDGKKTFFRGLE 300

301 SQTKLVNGQSHISLSKAEFQDALEKLNMGITDLQGLRLYVAAAIIESPGG 350
    |||||||||||||||||||||||||||||||||||||||||||||||||
301 SQTKLVNGQSHISLSKAEFQDALEKLNMGITDLQGLRLYVAAAIIESPGG 350

351 EMEEAELTSWYFVSSPFSLDLSKTKRHLVPGAPFLLQALVREMSGSPASG 400
    |||||||||||||||||||||||||||||||||||||||||||||||||
351 EMEEAELTSWYFVSSPFSLDLSKTKRHLVPGAPFLLQALVREMSGSPASG 400

401 IPVKVSATVSSPGSVPEVQDIQQNTDGSGQVSIPIIIPQTISELQLSVSA 450
    |||||||||||||||||||||||||||||||||||||||||||||||||
401 IPVKVSATVSSPGSVPEVQDIQQNTDGSGQVSIPIIIPQTISELQLSVSA 450

451 GSPHPAIARLTVAAPPSGGPGFLSIERPDSRPPRVGDTLNLNLRAVGSGA 500
    |||||||||||||||||||||||||||||||||||||||||||||||||
451 GSPHPAIARLTVAAPPSGGPGFLSIERPDSRPPRVGDTLNLNLRAVGSGA 500

501 TFSHYYYMILSRGQIVFMNREPKRTLTSVSVFVDHHLAPSFYFVAFYYHG 550
    |||||||||||||||||||||||||||||||||||||||||||||||||
501 TFSHYYYMILSRGQIVFMNREPKRTLTSVSVFVDHHLAPSFYFVAFYYHG 550

551 DHPVANSLRVDVQAGACEGKLELSVDGAKQYRNGESVKLHLETDSLALVA 600
    |||||||||||||||||||||||||||||||||||||||||||||||||
551 DHPVANSLRVDVQAGACEGKLELSVDGAKQYRNGESVKLHLETDSLALVA 600

601 LGALDTALYAAGSKSHKPLNMGKVFEAMNSYDLGCGPGGGDSALQVFQAA 650
    |||||||||||||||||||||||||||||||||||||||||||||||||
601 LGALDTALYAAGSKSHKPLNMGKVFEAMNSYDLGCGPGGGDSALQVFQAA 650

651 GLAFSDGDQWTLSRKRLSCPKEKTTRKKRNVNFQKAINEKLGQYASPTAK 700
    |||||||||||||||||||||||||||||||||||||||||||||||||
651 GLAFSDGDQWTLSRKRLSCPKEKTTRKKRNVNFQKAINEKLGQYASPTAK 700

701 RCCQDGVTRLPMMRSCEQRAARVQQPDCREPFLSCCQFAESLRKKSRDKG 750
    |||||||||||||||||||||||||||||||||||||||||||||||||
701 RCCQDGVTRLPMMRSCEQRAARVQQPDCREPFLSCCQFAESLRKKSRDKG 750

751 QAGLQRALEILQEEDLIDEDDIPVRSFFPENWLWRVETVDRFQILTLWLP 800
    |||||||||||||||||||||||||||||||||||||||||||||||||
751 QAGLQRALEILQEEDLIDEDDIPVRSFFPENWLWRVETVDRFQILTLWLP 800
```

```
801   DSLTTWEIHGLSLSKTKGLCVATPVQLRVFREFHLHLRLPMSVRRFEQLE   850
      ||||||||||||||||||||||||||||||||||||||||||||||||||
801   DSLTTWEIHGLSLSKTKGLCVATPVQLRVFREFHLHLRLPMSVRRFEQLE   850

851   LRPVLYNYLDKNLTVRPHRS                                 870
      ||||||||||||||||  ||
851   LRPVLYNYLDKNLTVSVHVS                                 870
```

Sequence name: CO4_HUMAN
Sequence documentation:
Alignment of: HSCOC4_PEA_1_P5 (SEQ ID NO:341) × CO4_HUMAN . . .
Alignment segment 1/1:
Quality: 7969.00
Escore: 0
Matching length: 818
Total length: 818
Matching Percent Similarity: 100.00
Matching Percent Identity: 100.00
Total Percent Similarity: 100.00
Total Percent Identity: 100.00
Gaps: 0
Alignment:

```
  1   MRLLWGLIWASSFFTLSLQKPRLLLFSPSVVHLGVPLSVGVQLQDVPRGQ    50
      ||||||||||||||||||||||||||||||||||||||||||||||||||
  1   MRLLWGLIWASSFFTLSLQKPRLLLFSPSVVHLGVPLSVGVQLQDVPRGQ    50

51   VVKGSVFLRNPSRNNVPCSPKVDFTLSSERDFALLSLQVPLKDAKSCGLH   100
      ||||||||||||||||||||||||||||||||||||||||||||||||||
 51   VVKGSVFLRNPSRNNVPCSPKVDFTLSSERDFALLSLQVPLKDAKSCGLH   100

101   QLLRGPEVQLVAHSPWLKDSLSRTTNIQGINLLFSSRRGHLFLQTDQPIY   150
      ||||||||||||||||||||||||||||||||||||||||||||||||||
101   QLLRGPEVQLVAHSPWLKDSLSRTTNIQGINLLFSSRRGHLFLQTDQPIY   150

151   NPGQRVRYRVFALDQKMRPSTDTITVMVENSHGLRVRKKEVYMPSSIFQD   200
      ||||||||||||||||||||||||||||||||||||||||||||||||||
151   NPGQRVRYRVFALDQKMRPSTDTITVMVENSHGLRVRKKEVYMPSSIFQD   200

201   DFVIPDISEPGTWKISARFSDGLESNSSTQFEVKKYVLPNFEVKITPGKP   250
      ||||||||||||||||||||||||||||||||||||||||||||||||||
201   DFVIPDISEPGTWKISARFSDGLESNSSTQFEVKKYVLPNFEVKITPGKP   250

251   YILTVPGHLDEMQLDIQARYIYGKPVQGVAYVRFGLLDEDGKKTFFRGLE   300
      ||||||||||||||||||||||||||||||||||||||||||||||||||
251   YILTVPGHLDEMQLDIQARYIYGKPVQGVAYVRFGLLDEDGKKTFFRGLE   300

301   SQTKLVNGQSHISLSKAEFQDALEKLNMGITDLQGLRLYVAAAIIESPGG   350
      ||||||||||||||||||||||||||||||||||||||||||||||||||
301   SQTKLVNGQSHISLSKAEFQDALEKLNMGITDLQGLRLYVAAAIIESPGG   350

351   EMEEAELTSWYFVSSPFSLDLSKTKRHLVPGAPFLLQALVREMSGSPASG   400
      ||||||||||||||||||||||||||||||||||||||||||||||||||
351   EMEEAELTSWYFVSSPFSLDLSKTKRHLVPGAPFLLQALVREMSGSPASG   400

401   IPVKVSATVSSPGSVPEVQDIQQNTDGSGQVSIPIIIPQTISELQLSVSA   450
      ||||||||||||||||||||||||||||||||||||||||||||||||||
401   IPVKVSATVSSPGSVPEVQDIQQNTDGSGQVSIPIIIPQTISELQLSVSA   450

451   GSPHPAIARLTVAAPPSGGPGFLSIERPDSRPPRVGDTLNLNLRAVGSGA   500
      ||||||||||||||||||||||||||||||||||||||||||||||||||
451   GSPHPAIARLTVAAPPSGGPGFLSIERPDSRPPRVGDTLNLNLRAVGSGA   500

501   TFSHYYYMILSRGQIVFMNREPKRTLTSVSVFVDHHLAPSFYFVAFYYHG   550
      ||||||||||||||||||||||||||||||||||||||||||||||||||
501   TFSHYYYMILSRGQIVFMNREPKRTLTSVSVFVDHHLAPSFYFVAFYYHG   550
```

```
551  DHPVANSLRVDVQAGACEGKLELSVDGAKQYRNGESVKLHLETDSLALVA   600
     ||||||||||||||||||||||||||||||||||||||||||||||||||
551  DHPVANSLRVDVQAGACEGKLELSVDGAKQYRNGESVKLHLETDSLALVA   600

601  LGALDTALYAAGSKSHKPLNMGKVFEAMNSYDLGCGPGGGDSALQVFQAA   650
     |||||||||||||||||||||||||||||||||||||||||||||||||
601  LGALDTALYAAGSKSHKPLNMGKVFEAMNSYDLGCGPGGGDSALQVFQAA   650

651  GLAFSDGDQWTLSRKRLSCPKEKTTRKKRNVNFQKAINEKLGQYASPTAK   700
     |||||||||||||||||||||||||||||||||||||||||||||||||
651  GLAFSDGDQWTLSRKRLSCPKEKTTRKKRNVNFQKAINEKLGQYASPTAK   700

701  RCCQDGVTRLPMMRSCEQRAARVQQPDCREPFLSCCQFAESLRKKSRDKG   750
     |||||||||||||||||||||||||||||||||||||||||||||||||
701  RCCQDGVTRLPMMRSCEQRAARVQQPDCREPFLSCCQFAESLRKKSRDKG   750

751  QAGLQRALEILQEEDLIDEDDIPVRSFFPENWLWRVETVDRFQILTLWLP   800
     |||||||||||||||||||||||||||||||||||||||||||||||||
751  QAGLQRALEILQEEDLIDEDDIPVRSFFPENWLWRVETVDRFQILTLWLP   800

801  DSLTTWEIHGLSLSKTKG                                  818
     ||||||||||||||||||
801  DSLTTWEIHGLSLSKTKG                                  818
```

Sequence name: CO4_HUMAN
Sequence documentation:
Alignment of: HSCOC4_PEA_1_P6 (SEQ ID NO:342) x CO4_HUMAN . . .
Alignment segment 1/1:
Quality: 10211.00
Escore: 0
Matching length: 1052
Total length: 1052
Matching Percent Similarity: 100.00
Matching Percent Identity: 100.00
Total Percent Similarity: 100.00
Total Percent Identity: 100.00
Gaps: 0
Alignment:

```
  1  MRLLWGLIWASSFFTLSLQKPRLLLFSPSVVHLGVPLSVGVQLQDVPRGQ    50
     ||||||||||||||||||||||||||||||||||||||||||||||||||
  1  MRLLWGLIWASSFFTLSLQKPRLLLFSPSVVHLGVPLSVGVQLQDVPRGQ    50

51  VVKGSVFLRNPSRNNVPCSPKVDFTLSSERDFALLSLQVPLKDAKSCGLH   100
     ||||||||||||||||||||||||||||||||||||||||||||||||||
 51  VVKGSVFLRNPSRNNVPCSPKVDFTLSSERDFALLSLQVPLKDAKSCGLH   100

101  QLLRGPEVQLVAHSPWLKDSLSRTTNIQGINLLFSSRRGHLFLQTDQPIY   150
     |||||||||||||||||||||||||||||||||||||||||||||||||
101  QLLRGPEVQLVAHSPWLKDSLSRTTNIQGINLLFSSRRGHLFLQTDQPIY   150

151  NPGQRVRYRVFALDQKMRPSTDTITVMVENSHGLRVRKKEVYMPSSIFQD   200
     |||||||||||||||||||||||||||||||||||||||||||||||||
151  NPGQRVRYRVFALDQKMRPSTDTITVMVENSHGLRVRKKEVYMPSSIFQD   200

201  DFVIPDISEPGTWKISARFSDGLESNSSTQFEVKKYVLPNFEVKITPGKP   250
     |||||||||||||||||||||||||||||||||||||||||||||||||
201  DFVIPDISEPGTWKISARFSDGLESNSSTQFEVKKYVLPNFEVKITPGKP   250

251  YILTVPGHLDEMQLDIQARYIYGKPVQGVAYVRFGLLDEDGKKTFFRGLE   300
     |||||||||||||||||||||||||||||||||||||||||||||||||
251  YILTVPGHLDEMQLDIQARYIYGKPVQGVAYVRFGLLDEDGKKTFFRGLE   300

301  SQTKLVNGQSHISLSKAEFQDALEKLNMGITDLQGLRLYVAAAIIESPGG   350
     |||||||||||||||||||||||||||||||||||||||||||||||||
301  SQTKLVNGQSHISLSKAEFQDALEKLNMGITDLQGLRLYVAAAIIESPGG   350
```

-continued

```
351 EMEEAELTSWYFVSSPFSLDLSKTKRHLVPGAPFLLQALVREMSGSPASG 400
    ||||||||||||||||||||||||||||||||||||||||||||||||||
351 EMEEAELTSWYFVSSPFSLDLSKTKRHLVPGAPFLLQALVREMSGSPASG 400

401 IPVKVSATVSSPGSVPEVQDIQQNTDGSGQVSIPIIIPQTISELQLSVSA 450
    ||||||||||||||||||||||||||||||||||||||||||||||||||
401 IPVKVSATVSSPGSVPEVQDIQQNTDGSGQVSIPIIIPQTISELQLSVSA 450

451 GSPHPAIARLTVAAPPSGGPGFLSIERPDSRPPRVGDTLNLNLRAVGSGA 500
    ||||||||||||||||||||||||||||||||||||||||||||||||||
451 GSPHPAIARLTVAAPPSGGPGFLSIERPDSRPPRVGDTLNLNLRAVGSGA 500

501 TFSHYYYMILSRGQIVFMNREPKRTLTSVSVFVDHHLAPSFYFVAFYYHG 550
    ||||||||||||||||||||||||||||||||||||||||||||||||||
501 TFSHYYYMILSRGQIVFMNREPKRTLTSVSVFVDHHLAPSFYFVAFYYHG 550

551 DHPVANSLRVDVQAGACEGKLELSVDGAKQYRNGESVKLHLETDSLALVA 600
    ||||||||||||||||||||||||||||||||||||||||||||||||||
551 DHPVANSLRVDVQAGACEGKLELSVDGAKQYRNGESVKLHLETDSLALVA 600

601 LGALDTALYAAGSKSHKPLNMGKVFEAMNSYDLGCGPGGGDSALQVFQAA 650
    ||||||||||||||||||||||||||||||||||||||||||||||||||
601 LGALDTALYAAGSKSHKPLNMGKVFEAMNSYDLGCGPGGGDSALQVFQAA 650

651 GLAFSDGDQWTLSRKRLSCPKEKTTRKKRNVNFQKAINEKLGQYASPTAK 700
    ||||||||||||||||||||||||||||||||||||||||||||||||||
651 GLAFSDGDQWTLSRKRLSCPKEKTTRKKRNVNFQKAINEKLGQYASPTAK 700

701 RCCQDGVTRLPMMRSCEQRAARVQQPDCREPFLSCCQFAESLRKKSRDKG 750
    ||||||||||||||||||||||||||||||||||||||||||||||||||
701 RCCQDGVTRLPMMRSCEQRAARVQQPDCREPFLSCCQFAESLRKKSRDKG 750

751 QAGLQRALEILQEEDLIDEDDIPVRSFFPENWLWRVETVDRFQILTLWLP 800
    ||||||||||||||||||||||||||||||||||||||||||||||||||
751 QAGLQRALEILQEEDLIDEDDIPVRSFFPENWLWRVETVDRFQILTLWLP 800

801 DSLTTWEIHGLSLSKTKGLCVATPVQLRVFREFHLHLRLPMSVRRFEQLE 850
    ||||||||||||||||||||||||||||||||||||||||||||||||||
801 DSLTTWEIHGLSLSKTKGLCVATPVQLRVFREFHLHLRLPMSVRRFEQLE 850

851 LRPVLYNYLDKNLTVSVHVSPVEGLCLAGGGGLAQQVLVPAGSARPVAFS 900
    ||||||||||||||||||||||||||||||||||||||||||||||||||
851 LRPVLYNYLDKNLTVSVHVSPVEGLCLAGGGGLAQQVLVPAGSARPVAFS 900

901 VVPTAAAAVSLKVVARGSFEFPVGDAVSKVLQIEKEGAIHREELVYELNP 950
    ||||||||||||||||||||||||||||||||||||||||||||||||||
901 VVPTAAAAVSLKVVARGSFEFPVGDAVSKVLQIEKEGAIHREELVYELNP 950

951 LDHRGRTLEIPGNSDPNMIPDGDFNSYVRVTASDPLDTLGSEGALSPGGV 1000
    ||||||||||||||||||||||||||||||||||||||||||||||||||
951 LDHRGRTLEIPGNSDPNMIPDGDFNSYVRVTASDPLDTLGSEGALSPGGV 1000

1001 ASLLRLPRGCGEQTMIYLAPTLAASRYLDKTEQWSTLPPETKDHAVDLIQ 1050
     ||||||||||||||||||||||||||||||||||||||||||||||||||
1001 ASLLRLPRGCGEQTMIYLAPTLAASRYLDKTEQWSTLPPETKDHAVDLIQ 1050

1051 KG 1052
     ||
1051 KG 1052
```

Sequence name: CO4_HUMAN_V1 (SEQ ID NO:389)
Sequence documentation:
Alignment of: HSCOC4_PEA_1_P12 (SEQ ID NO:343) × CO4_HUMAN_V1 (SEQ ID NO:389) . . .
Alignment segment 1/1:
Quality: 13367.00

-continued

Escore: 0
Matching length: 1380
Total length: 1380
Matching Percent Similarity: 100.00
Matching Percent Identity: 100.00
Total Percent Similarity: 100.00
Total Percent Identity: 100.00
Gaps: 0
Alignment:

```
  1   MRLLWGLIWASSFFTLSLQKPRLLLFSPSVVHLGVPLSVGVQLQDVPRGQ    50
      ||||||||||||||||||||||||||||||||||||||||||||||||||
  1   MRLLWGLIWASSFFTLSLQKPRLLLFSPSVVHLGVPLSVGVQLQDVPRGQ    50

51   VVKGSVFLRNPSRNNVPCSPKVDFTLSSERDFALLSLQVPLKDAKSCGLH   100
      ||||||||||||||||||||||||||||||||||||||||||||||||||
 51   VVKGSVFLRNPSRNNVPCSPKVDFTLSSERDFALLSLQVPLKDAKSCGLH   100

101   QLLRGPEVQLVAHSPWLKDSLSRTTNIQGINLLFSSRRGHLFLQTDQPIY   150
      ||||||||||||||||||||||||||||||||||||||||||||||||||
101   QLLRGPEVQLVAHSPWLKDSLSRTTNIQGINLLFSSRRGHLFLQTDQPIY   150

151   NPGQRVRYRVFALDQKMRPSTDTITVMVENSHGLRVRKKEVYMPSSIFQD   200
      ||||||||||||||||||||||||||||||||||||||||||||||||||
151   NPGQRVRYRVFALDQKMRPSTDTITVMVENSHGLRVRKKEVYMPSSIFQD   200

201   DFVIPDISEPGTWKISARFSDGLESNSSTQFEVKKYVLPNFEVKITPGKP   250
      ||||||||||||||||||||||||||||||||||||||||||||||||||
201   DFVIPDISEPGTWKISARFSDGLESNSSTQFEVKKYVLPNFEVKITPGKP   250

251   YILTVPGHLDEMQLDIQARYIYGKPVQGVAYVRFGLLDEDGKKTFFRGLE   300
      ||||||||||||||||||||||||||||||||||||||||||||||||||
251   YILTVPGHLDEMQLDIQARYIYGKPVQGVAYVRFGLLDEDGKKTFFRGLE   300

301   SQTKLVNGQSHISLSKAEFQDALEKLNMGITDLQGLRLYVAAAIIESPGG   350
      ||||||||||||||||||||||||||||||||||||||||||||||||||
301   SQTKLVNGQSHISLSKAEFQDALEKLNMGITDLQGLRLYVAAAIIESPGG   350

351   EMEEAELTSWYFVSSPFSLDLSKTKRHLVPGAPFLLQALVREMSGSPASG   400
      ||||||||||||||||||||||||||||||||||||||||||||||||||
351   EMEEAELTSWYFVSSPFSLDLSKTKRHLVPGAPFLLQALVREMSGSPASG   400

401   IPVKVSATVSSPGSVPEVQDIQQNTDGSGQVSIPIIIPQTISELQLSVSA   450
      ||||||||||||||||||||||||||||||||||||||||||||||||||
401   IPVKVSATVSSPGSVPEVQDIQQNTDGSGQVSIPIIIPQTISELQLSVSA   450

451   GSPHPAIARLTVAAPPSGGPGFLSIERPDSRPPRVGDTLNLNLRAVGSGA   500
      ||||||||||||||||||||||||||||||||||||||||||||||||||
451   GSPHPAIARLTVAAPPSGGPGFLSIERPDSRPPRVGDTLNLNLRAVGSGA   500

501   TFSHYYYMILSRGQIVFMNREPKRTLTSVSVFVDHHLAPSFYFVAFYYHG   550
      ||||||||||||||||||||||||||||||||||||||||||||||||||
501   TFSHYYYMILSRGQIVFMNREPKRTLTSVSVFVDHHLAPSFYFVAFYYHG   550

551   DHPVANSLRVDVQAGACEGKLELSVDGAKQYRNGESVKLHLETDSLALVA   600
      ||||||||||||||||||||||||||||||||||||||||||||||||||
551   DHPVANSLRVDVQAGACEGKLELSVDGAKQYRNGESVKLHLETDSLALVA   600

601   LGALDTALYAAGSKSHKPLNMGKVFEAMNSYDLGCGPGGGDSALQVFQAA   650
      ||||||||||||||||||||||||||||||||||||||||||||||||||
601   LGALDTALYAAGSKSHKPLNMGKVFEAMNSYDLGCGPGGGDSALQVFQAA   650

651   GLAFSDGDQWTLSRKRLSCPKEKTTRKKRNVNFQKAINEKLGQYASPTAK   700
      ||||||||||||||||||||||||||||||||||||||||||||||||||
651   GLAFSDGDQWTLSRKRLSCPKEKTTRKKRNVNFQKAINEKLGQYASPTAK   700
```

```
701  RCCQDGVTRLPMMRSCEQRAARVQQPDCREPFLSCCQFAESLRKKSRDKG  750
     ||||||||||||||||||||||||||||||||||||||||||||||||||
701  RCCQDGVTRLPMMRSCEQRAARVQQPDCREPFLSCCQFAESLRKKSRDKG  750

751  QAGLQRALEILQEEDLIDEDDIPVRSFFPENWLWRVETVDRFQILTLWLP  800
     ||||||||||||||||||||||||||||||||||||||||||||||||||
751  QAGLQRALEILQEEDLIDEDDIPVRSFFPENWLWRVETVDRFQILTLWLP  800

801  DSLTTWEIHGLSLSKTKGLCVATPVQLRVFREFHLHLRLPMSVRRFEQLE  850
     ||||||||||||||||||||||||||||||||||||||||||||||||||
801  DSLTTWEIHGLSLSKTKGLCVATPVQLRVFREFHLHLRLPMSVRRFEQLE  850

851  LRPVLYNYLDKNLTVSVHVSPVEGLCLAGGGGLAQQVLVPAGSARPVAFS  900
     ||||||||||||||||||||||||||||||||||||||||||||||||||
851  LRPVLYNYLDKNLTVSVHVSPVEGLCLAGGGGLAQQVLVPAGSARPVAFS  900

901  VVPTAAAAVSLKVVARGSFEFPVGDAVSKVLQIEKEGAIHREELVYELNP  950
     ||||||||||||||||||||||||||||||||||||||||||||||||||
901  VVPTAAAAVSLKVVARGSFEFPVGDAVSKVLQIEKEGAIHREELVYELNP  950

951  LDHRGRTLEIPGNSDPNMIPDGDFNSYVRVTASDPLDTLGSEGALSPGGV  1000
     ||||||||||||||||||||||||||||||||||||||||||||||||||
951  LDHRGRTLEIPGNSDPNMIPDGDFNSYVRVTASDPLDTLGSEGALSPGGV  1000

1001 ASLLRLPRGCGEQTMIYLAPTLAASRYLDKTEQWSTLPPETKDHAVDLIQ  1050
     ||||||||||||||||||||||||||||||||||||||||||||||||||
1001 ASLLRLPRGCGEQTMIYLAPTLAASRYLDKTEQWSTLPPETKDHAVDLIQ  1050

1051 KGYMRIQQFRKADGSYAAWLSRDSSTWLTAFVLKVLSLAQEQVGGSPEKL  1100
     ||||||||||||||||||||||||||||||||||||||||||||||||||
1051 KGYMRIQQFRKADGSYAAWLSRDSSTWLTAFVLKVLSLAQEQVGGSPEKL  1100

1101 QETSNWLLSQQQADGSFQDPCPVLDRSMQGGLVGNDETVALTAFVTIALH  1150
     ||||||||||||||||||||||||||||||||||||||||||||||||||
1101 QETSNWLLSQQQADGSFQDPCPVLDRSMQGGLVGNDETVALTAFVTIALH  1150

1151 HGLAVFQDEGAEPLKQRVEASISKASSFLGEKASAGLLGAHAAAITAYAL  1200
     ||||||||||||||||||||||||||||||||||||||||||||||||||
1151 HGLAVFQDEGAEPLKQRVEASISKASSFLGEKASAGLLGAHAAAITAYAL  1200

1201 TLTKAPADLRGVAHNNLMAMAQETGDNLYWGSVTGSQSNAVSPTPAPRNP  1250
     ||||||||||||||||||||||||||||||||||||||||||||||||||
1201 TLTKAPADLRGVAHNNLMAMAQETGDNLYWGSVTGSQSNAVSPTPAPRNP  1250

1251 SDPMPQAPALWIETTAYALLHLLLHEGKAEMADQAAAWLTRQGSFQGGFR  1300
     ||||||||||||||||||||||||||||||||||||||||||||||||||
1251 SDPMPQAPALWIETTAYALLHLLLHEGKAEMADQAAAWLTRQGSFQGGFR  1300

1301 STQDTVIALDALSAYWIASHTTEERGLNVTLSSTGRNGFKSHALQLNNRQ  1350
     ||||||||||||||||||||||||||||||||||||||||||||||||||
1301 STQDTVIALDALSAYWIASHTTEERGLNVTLSSTGRNGFKSHALQLNNRQ  1350

1351 IRGLEEELQFSLGSKINVKVGGNSKGTLKV  1380
     ||||||||||||||||||||||||||||||
1351 IRGLEEELQFSLGSKINVKVGGNSKGTLKV  1380
```

Sequence name: CO4_HUMAN_V1 (SEQ ID NO:389)
Sequence documentation:
Alignment of: HSCOC4_PEA_1_P15 (SEQ ID NO:344) x CO4_HUMAN_V1 (SEQ ID NO:389) . . .
Alignment segment 1/1:
Quality: 13174.00
Escore: 0
Matching length: 1359
Total length: 1359
Matching Percent Similarity: 100.00

-continued

Matching Percent Identity: 100.00
Total Percent Similarity: 100.00
Total Percent Identity: 100.00
Gaps: 0
Alignment:

```
  1  MRLLWGLIWASSFFTLSLQKPRLLLFSPSVVHLGVPLSVGVQLQDVPRGQ   50
     ||||||||||||||||||||||||||||||||||||||||||||||||||
  1  MRLLWGLIWASSFFTLSLQKPRLLLFSPSVVHLGVPLSVGVQLQDVPRGQ   50

51  VVKGSVFLRNPSRNNVPCSPKVDFTLSSERDFALLSLQVPLKDAKSCGLH  100
     ||||||||||||||||||||||||||||||||||||||||||||||||||
 51  VVKGSVFLRNPSRNNVPCSPKVDFTLSSERDFALLSLQVPLKDAKSCGLH  100

101  QLLRGPEVQLVAHSPWLKDSLSRTTNIQGINLLFSSRRGHLFLQTDQPIY  150
     ||||||||||||||||||||||||||||||||||||||||||||||||||
101  QLLRGPEVQLVAHSPWLKDSLSRTTNIQGINLLFSSRRGHLFLQTDQPIY  150

151  NPGQRVRYRVFALDQKMRPSTDTITVMVENSHGLRVRKKEVYMPSSIFQD  200
     ||||||||||||||||||||||||||||||||||||||||||||||||||
151  NPGQRVRYRVFALDQKMRPSTDTITVMVENSHGLRVRKKEVYMPSSIFQD  200

201  DFVIPDISEPGTWKISARFSDGLESNSSTQFEVKKYVLPNFEVKITPGKP  250
     ||||||||||||||||||||||||||||||||||||||||||||||||||
201  DFVIPDISEPGTWKISARFSDGLESNSSTQFEVKKYVLPNFEVKITPGKP  250

251  YILTVPGHLDEMQLDIQARYIYGKPVQGVAYVRFGLLDEDGKKTFFRGLE  300
     ||||||||||||||||||||||||||||||||||||||||||||||||||
251  YILTVPGHLDEMQLDIQARYIYGKPVQGVAYVRFGLLDEDGKKTFFRGLE  300

301  SQTKLVNGQSHISLSKAEFQDALEKLNMGITDLQGLRLYVAAAIIESPGG  350
     ||||||||||||||||||||||||||||||||||||||||||||||||||
301  SQTKLVNGQSHISLSKAEFQDALEKLNMGITDLQGLRLYVAAAIIESPGG  350

351  EMEEAELTSWYFVSSPFSLDLSKTKRHLVPGAPFLLQALVREMSGSPASG  400
     ||||||||||||||||||||||||||||||||||||||||||||||||||
351  EMEEAELTSWYFVSSPFSLDLSKTKRHLVPGAPFLLQALVREMSGSPASG  400

401  IPVKVSATVSSPGSVPEVQDIQQNTDGSGQVSIPIIIPQTISELQLSVSA  450
     ||||||||||||||||||||||||||||||||||||||||||||||||||
401  IPVKVSATVSSPGSVPEVQDIQQNTDGSGQVSIPIIIPQTISELQLSVSA  450

451  GSPHPAIARLTVAAPPSGGPGFLSIERPDSRPPRVGDTLNLNLRAVGSGA  500
     ||||||||||||||||||||||||||||||||||||||||||||||||||
451  GSPHPAIARLTVAAPPSGGPGFLSIERPDSRPPRVGDTLNLNLRAVGSGA  500

501  TFSHYYYMILSRGQIVFMNREPKRTLTSVSVFVDHHLAPSFYFVAFYYHG  550
     ||||||||||||||||||||||||||||||||||||||||||||||||||
501  TFSHYYYMILSRGQIVFMNREPKRTLTSVSVFVDHHLAPSFYFVAFYYHG  550

551  DHPVANSLRVDVQAGACEGKLELSVDGAKQYRNGESVKLHLETDSLALVA  600
     ||||||||||||||||||||||||||||||||||||||||||||||||||
551  DHPVANSLRVDVQAGACEGKLELSVDGAKQYRNGESVKLHLETDSLALVA  600

601  LGALDTALYAAGSKSHKPLNMGKVFEAMNSYDLGCGPGGGDSALQVFQAA  650
     ||||||||||||||||||||||||||||||||||||||||||||||||||
601  LGALDTALYAAGSKSHKPLNMGKVFEAMNSYDLGCGPGGGDSALQVFQAA  650

651  GLAFSDGDQWTLSRKRLSCPKEKTTRKKRNVNFQKAINEKLGQYASPTAK  700
     ||||||||||||||||||||||||||||||||||||||||||||||||||
651  GLAFSDGDQWTLSRKRLSCPKEKTTRKKRNVNFQKAINEKLGQYASPTAK  700

701  RCCQDGVTRLPMMRSCEQRAARVQQPDCREPFLSCCQFAESLRKKSRDKG  750
     ||||||||||||||||||||||||||||||||||||||||||||||||||
701  RCCQDGVTRLPMMRSCEQRAARVQQPDCREPFLSCCQFAESLRKKSRDKG  750
```

```
 751   QAGLQRALEILQEEDLIDEDDIPVRSFFPENWLWRVETVDRFQILTLWLP    800
       ||||||||||||||||||||||||||||||||||||||||||||||||||
 751   QAGLQRALEILQEEDLIDEDDIPVRSFFPENWLWRVETVDRFQILTLWLP    800

801   DSLTTWEIHGLSLSKTKGLCVATPVQLRVFREFHLHLRLPMSVRRFEQLE    850
       |||||||||||||||||||||||||||||||||||||||||||||||||
 801   DSLTTWEIHGLSLSKTKGLCVATPVQLRVFREFHLHLRLPMSVRRFEQLE    850

851   LRPVLYNYLDKNLTVSVHVSPVEGLCLAGGGGLAQQVLVPAGSARPVAFS    900
       |||||||||||||||||||||||||||||||||||||||||||||||||
 851   LRPVLYNYLDKNLTVSVHVSPVEGLCLAGGGGLAQQVLVPAGSARPVAFS    900

901   VVPTAAAAVSLKVVARGSFEFPVGDAVSKVLQIEKEGAIHREELVYELNP    950
       |||||||||||||||||||||||||||||||||||||||||||||||||
 901   VVPTAAAAVSLKVVARGSFEFPVGDAVSKVLQIEKEGAIHREELVYELNP    950

951   LDHRGRTLEIPGNSDPNMIPDGDFNSYVRVTASDPLDTLGSEGALSPGGV   1000
       |||||||||||||||||||||||||||||||||||||||||||||||||
 951   LDHRGRTLEIPGNSDPNMIPDGDFNSYVRVTASDPLDTLGSEGALSPGGV   1000

1001   ASLLRLPRGCGEQTMIYLAPTLAASRYLDKTEQWSTLPPETKDHAVDLIQ   1050
       |||||||||||||||||||||||||||||||||||||||||||||||||
1001   ASLLRLPRGCGEQTMIYLAPTLAASRYLDKTEQWSTLPPETKDHAVDLIQ   1050

1051   KGYMRIQQFRKADGSYAAWLSRDSSTWLTAFVLKVLSLAQEQVGGSPEKL   1100
       |||||||||||||||||||||||||||||||||||||||||||||||||
1051   KGYMRIQQFRKADGSYAAWLSRDSSTWLTAFVLKVLSLAQEQVGGSPEKL   1100

1101   QETSNWLLSQQQADGSFQDPCPVLDRSMQGGLVGNDETVALTAFVTIALH   1150
       |||||||||||||||||||||||||||||||||||||||||||||||||
1101   QETSNWLLSQQQADGSFQDPCPVLDRSMQGGLVGNDETVALTAFVTIALH   1150

1151   HGLAVFQDEGAEPLKQRVEASISKASSFLGEKASAGLLGAHAAAITAYAL   1200
       |||||||||||||||||||||||||||||||||||||||||||||||||
1151   HGLAVFQDEGAEPLKQRVEASISKASSFLGEKASAGLLGAHAAAITAYAL   1200

1201   TLTKAPADLRGVAHNNLMAMAQETGDNLYWGSVTGSQSNAVSPTPAPRNP   1250
       |||||||||||||||||||||||||||||||||||||||||||||||||
1201   TLTKAPADLRGVAHNNLMAMAQETGDNLYWGSVTGSQSNAVSPTPAPRNP   1250

1251   SDPMPQAPALWIETTAYALLHLLLHEGKAEMADQAAAWLTRQGSFQGGFR   1300
       |||||||||||||||||||||||||||||||||||||||||||||||||
1251   SDPMPQAPALWIETTAYALLHLLLHEGKAEMADQAAAWLTRQGSFQGGFR   1300

1301   STQDTVIALDALSAYWIASHTTEERGLNVTLSSTGRNGFKSHALQLNNRQ   1350
       |||||||||||||||||||||||||||||||||||||||||||||||||
1301   STQDTVIALDALSAYWIASHTTEERGLNVTLSSTGRNGFKSHALQLNNRQ   1350

1351   IRGLEEELQ   1359
       |||||||||
1351   IRGLEEELQ   1359
```

Sequence name: CO4_HUMAN_V1 (SEQ ID NO:389)
Sequence documentation:
Alignment of: HSCOC4_PEA_1_P16 (SEQ ID NO:345) × CO4_HUMAN_V1 (SEQ ID NO:389) . . .
Alignment segment 1/1:
Quality: 14137.00
Escore: 0
Matching length: 1457
Total length: 1457
Matching Percent Similarity: 100.00
Matching Percent Identity: 100.00
Total Percent Similarity: 100.00
Total Percent Identity: 100.00
Gaps: 0

-continued

Alignment:

```
  1 MRLLWGLIWASSFFTLSLQKPRLLLFSPSVVHLGVPLSVGVQLQDVPRGQ  50
    ||||||||||||||||||||||||||||||||||||||||||||||||||
  1 MRLLWGLIWASSFFTLSLQKPRLLLFSPSVVHLGVPLSVGVQLQDVPRGQ  50

51 VVKGSVFLRNPSRNNVPCSPKVDFTLSSERDFALLSLQVPLKDAKSCGLH 100
    ||||||||||||||||||||||||||||||||||||||||||||||||||
 51 VVKGSVFLRNPSRNNVPCSPKVDFTLSSERDFALLSLQVPLKDAKSCGLH 100

101 QLLRGPEVQLVAHSPWLKDSLSRTTNIQGINLLFSSRRGHLFLQTDQPIY 150
    ||||||||||||||||||||||||||||||||||||||||||||||||||
101 QLLRGPEVQLVAHSPWLKDSLSRTTNIQGINLLFSSRRGHLFLQTDQPIY 150

151 NPGQRVRYRVFALDQKMRPSTDTITVMVENSHGLRVRKKEVYMPSSIFQD 200
    ||||||||||||||||||||||||||||||||||||||||||||||||||
151 NPGQRVRYRVFALDQKMRPSTDTITVMVENSHGLRVRKKEVYMPSSIFQD 200

201 DFVIPDISEPGTWKISARFSDGLESNSSTQFEVKKYVLPNFEVKITPGKP 250
    ||||||||||||||||||||||||||||||||||||||||||||||||||
201 DFVIPDISEPGTWKISARFSDGLESNSSTQFEVKKYVLPNFEVKITPGKP 250

251 YILTVPGHLDEMQLDIQARYIYGKPVQGVAYVRFGLLDEDGKKTFFRGLE 300
    ||||||||||||||||||||||||||||||||||||||||||||||||||
251 YILTVPGHLDEMQLDIQARYIYGKPVQGVAYVRFGLLDEDGKKTFFRGLE 300

301 SQTKLVNGQSHISLSKAEFQDALEKLNMGITDLQGLRLYVAAAIIESPGG 350
    ||||||||||||||||||||||||||||||||||||||||||||||||||
301 SQTKLVNGQSHISLSKAEFQDALEKLNMGITDLQGLRLYVAAAIIESPGG 350

351 EMEEAELTSWYFVSSPFSLDLSKTKRHLVPGAPFLLQALVREMSGSPASG 400
    ||||||||||||||||||||||||||||||||||||||||||||||||||
351 EMEEAELTSWYFVSSPFSLDLSKTKRHLVPGAPFLLQALVREMSGSPASG 400

401 IPVKVSATVSSPGSVPEVQDIQQNTDGSGQVSIPIIIPQTISELQLSVSA 450
    ||||||||||||||||||||||||||||||||||||||||||||||||||
401 IPVKVSATVSSPGSVPEVQDIQQNTDGSGQVSIPIIIPQTISELQLSVSA 450

451 GSPHPAIARLTVAAPPSGGPGFLSIERPDSRPPRVGDTLNLNLRAVGSGA 500
    ||||||||||||||||||||||||||||||||||||||||||||||||||
451 GSPHPAIARLTVAAPPSGGPGFLSIERPDSRPPRVGDTLNLNLRAVGSGA 500

501 TFSHYYYMILSRGQIVFMNREPKRTLTSVSVFVDHHLAPSFYFVAFYYHG 550
    ||||||||||||||||||||||||||||||||||||||||||||||||||
501 TFSHYYYMILSRGQIVFMNREPKRTLTSVSVFVDHHLAPSFYFVAFYYHG 550

551 DHPVANSLRVDVQAGACEGKLELSVDGAKQYRNGESVKLHLETDSLALVA 600
    ||||||||||||||||||||||||||||||||||||||||||||||||||
551 DHPVANSLRVDVQAGACEGKLELSVDGAKQYRNGESVKLHLETDSLALVA 600

601 LGALDTALYAAGSKSHKPLNMGKVFEAMNSYDLGCGPGGGDSALQVFQAA 650
    ||||||||||||||||||||||||||||||||||||||||||||||||||
601 LGALDTALYAAGSKSHKPLNMGKVFEAMNSYDLGCGPGGGDSALQVFQAA 650

651 GLAFSDGDQWTLSRKRLSCPKEKTTRKKRNVNFQKAINEKLGQYASPTAK 700
    ||||||||||||||||||||||||||||||||||||||||||||||||||
651 GLAFSDGDQWTLSRKRLSCPKEKTTRKKRNVNFQKAINEKLGQYASPTAK 700

701 RCCQDGVTRLPMMRSCEQRAARVQQPDCREPFLSCCQFAESLRKKSRDKG 750
    ||||||||||||||||||||||||||||||||||||||||||||||||||
701 RCCQDGVTRLPMMRSCEQRAARVQQPDCREPFLSCCQFAESLRKKSRDKG 750
```

```
751  QAGLQRALEILQEEDLIDEDDIPVRSFFPENWLWRVETVDRFQILTLWLP  800
     ||||||||||||||||||||||||||||||||||||||||||||||||||
751  QAGLQRALEILQEEDLIDEDDIPVRSFFPENWLWRVETVDRFQILTLWLP  800

801  DSLTTWEIHGLSLSKTKGLCVATPVQLRVFREFHLHLRLPMSVRRFEQLE  850
     ||||||||||||||||||||||||||||||||||||||||||||||||||
801  DSLTTWEIHGLSLSKTKGLCVATPVQLRVFREFHLHLRLPMSVRRFEQLE  850

851  LRPVLYNYLDKNLTVSVHVSPVEGLCLAGGGGLAQQVLVPAGSARPVAFS  900
     ||||||||||||||||||||||||||||||||||||||||||||||||||
851  LRPVLYNYLDKNLTVSVHVSPVEGLCLAGGGGLAQQVLVPAGSARPVAFS  900

901  VVPTAAAAVSLKVVARGSFEFPVGDAVSKVLQIEKEGAIHREELVYELNP  950
     ||||||||||||||||||||||||||||||||||||||||||||||||||
901  VVPTAAAAVSLKVVARGSFEFPVGDAVSKVLQIEKEGAIHREELVYELNP  950

951  LDHRGRTLEIPGNSDPNMIPDGDFNSYVRVTASDPLDTLGSEGALSPGGV  1000
     ||||||||||||||||||||||||||||||||||||||||||||||||||
951  LDHRGRTLEIPGNSDPNMIPDGDFNSYVRVTASDPLDTLGSEGALSPGGV  1000

1001 ASLLRLPRGCGEQTMIYLAPTLAASRYLDKTEQWSTLPPETKDHAVDLIQ  1050
     ||||||||||||||||||||||||||||||||||||||||||||||||||
1001 ASLLRLPRGCGEQTMIYLAPTLAASRYLDKTEQWSTLPPETKDHAVDLIQ  1050

1051 KGYMRIQQFRKADGSYAAWLSRDSSTWLTAFVLKVLSLAQEQVGGSPEKL  1100
     ||||||||||||||||||||||||||||||||||||||||||||||||||
1051 KGYMRIQQFRKADGSYAAWLSRDSSTWLTAFVLKVLSLAQEQVGGSPEKL  1100

1101 QETSNWLLSQQQADGSFQDPCPVLDRSMQGGLVGNDETVALTAFVTIALH  1150
     ||||||||||||||||||||||||||||||||||||||||||||||||||
1101 QETSNWLLSQQQADGSFQDPCPVLDRSMQGGLVGNDETVALTAFVTIALH  1150

1151 HGLAVFQDEGAEPLKQRVEASISKASSFLGEKASAGLLGAHAAAITAYAL  1200
     ||||||||||||||||||||||||||||||||||||||||||||||||||
1151 HGLAVFQDEGAEPLKQRVEASISKASSFLGEKASAGLLGAHAAAITAYAL  1200

1201 TLTKAPADLRGVAHNNLMAMAQETGDNLYWGSVTGSQSNAVSPTPAPRNP  1250
     ||||||||||||||||||||||||||||||||||||||||||||||||||
1201 TLTKAPADLRGVAHNNLMAMAQETGDNLYWGSVTGSQSNAVSPTPAPRNP  1250

1251 SDPMPQAPALWIETTAYALLHLLLHEGKAEMADQAAAWLTRQGSFQGGFR  1300
     ||||||||||||||||||||||||||||||||||||||||||||||||||
1251 SDPMPQAPALWIETTAYALLHLLLHEGKAEMADQAAAWLTRQGSFQGGFR  1300

1301 STQDTVIALDALSAYWIASHTTEERGLNVTLSSTGRNGFKSHALQLNNRQ  1350
     ||||||||||||||||||||||||||||||||||||||||||||||||||
1301 STQDTVIALDALSAYWIASHTTEERGLNVTLSSTGRNGFKSHALQLNNRQ  1350

1351 IRGLEEELQFSLGSKINVKVGGNSKGTLKVLRTYNVLDMKNTTCQDLQIE  1400
     ||||||||||||||||||||||||||||||||||||||||||||||||||
1351 IRGLEEELQFSLGSKINVKVGGNSKGTLKVLRTYNVLDMKNTTCQDLQIE  1400

1401 VTVKGHVEYTMEANEDYEDYEYDELPAKDDPDAPLQPVTPLQLFEGRRNR  1450
     ||||||||||||||||||||||||||||||||||||||||||||||||||
1401 VTVKGHVEYTMEANEDYEDYEYDELPAKDDPDAPLQPVTPLQLFEGRRNR  1450

1451 RRREAPK  1457
     |||||||
1451 RRREAPK  1457
```

Sequence name: CO4_HUMAN_V1 (SEQ ID NO:389)
Sequence documentation:
Alignment of: HSCOC4_PEA_1_P20 (SEQ ID NO:346) × CO4_HUMAN_V1 (SEQ ID NO:389) . . .
Alignment segment 1/1:
Quality: 12641.00

-continued

```
Escore: 0
Matching length: 1303
Total length: 1303
Matching Percent Similarity: 100.00
Matching Percent Identity: 100.00
Total Percent Similarity: 100.00
Total Percent Identity: 100.00
Gaps: 0
Alignment:

1   MRLLWGLIWASSFFTLSLQKPRLLLFSPSVVHLGVPLSVGVQLQDVPRGQ   50
      ||||||||||||||||||||||||||||||||||||||||||||||||||
  1   MRLLWGLIWASSFFTLSLQKPRLLLFSPSVVHLGVPLSVGVQLQDVPRGQ   50

51   VVKGSVFLRNPSRNNVPCSPKVDFTLSSERDFALLSLQVPLKDAKSCGLH  100
      ||||||||||||||||||||||||||||||||||||||||||||||||||
 51   VVKGSVFLRNPSRNNVPCSPKVDFTLSSERDFALLSLQVPLKDAKSCGLH  100

101   QLLRGPEVQLVAHSPWLKDSLSRTTNIQGINLLFSSRRGHLFLQTDQPIY  150
      ||||||||||||||||||||||||||||||||||||||||||||||||||
101   QLLRGPEVQLVAHSPWLKDSLSRTTNIQGINLLFSSRRGHLFLQTDQPIY  150

151   NPGQRVRYRVFALDQKMRPSTDTITVMVENSHGLRVRKKEVYMPSSIFQD  200
      ||||||||||||||||||||||||||||||||||||||||||||||||||
151   NPGQRVRYRVFALDQKMRPSTDTITVMVENSHGLRVRKKEVYMPSSIFQD  200

201   DFVIPDISEPGTWKISARFSDGLESNSSTQFEVKKYVLPNFEVKITPGKP  250
      ||||||||||||||||||||||||||||||||||||||||||||||||||
201   DFVIPDISEPGTWKISARFSDGLESNSSTQFEVKKYVLPNFEVKITPGKP  250

251   YILTVPGHLDEMQLDIQARYIYGKPVQGVAYVRFGLLDEDGKKTFFRGLE  300
      ||||||||||||||||||||||||||||||||||||||||||||||||||
251   YILTVPGHLDEMQLDIQARYIYGKPVQGVAYVRFGLLDEDGKKTFFRGLE  300

301   SQTKLVNGQSHISLSKAEFQDALEKLNMGITDLQGLRLYVAAAIIESPGG  350
      ||||||||||||||||||||||||||||||||||||||||||||||||||
301   SQTKLVNGQSHISLSKAEFQDALEKLNMGITDLQGLRLYVAAAIIESPGG  350

351   EMEEAELTSWYFVSSPFSLDLSKTKRHLVPGAPFLLQALVREMSGSPASG  400
      ||||||||||||||||||||||||||||||||||||||||||||||||||
351   EMEEAELTSWYFVSSPFSLDLSKTKRHLVPGAPFLLQALVREMSGSPASG  400

401   IPVKVSATVSSPGSVPEVQDIQQNTDGSGQVSIPIIIPQTISELQLSVSA  450
      ||||||||||||||||||||||||||||||||||||||||||||||||||
401   IPVKVSATVSSPGSVPEVQDIQQNTDGSGQVSIPIIIPQTISELQLSVSA  450

451   GSPHPAIARLTVAAPPSGGPGFLSIERPDSRPPRVGDTLNLNLRAVGSGA  500
      ||||||||||||||||||||||||||||||||||||||||||||||||||
451   GSPHPAIARLTVAAPPSGGPGFLSIERPDSRPPRVGDTLNLNLRAVGSGA  500

501   TFSHYYYMILSRGQIVFMNREPKRTLTSVSVFVDHHLAPSFYFVAFYYHG  550
      ||||||||||||||||||||||||||||||||||||||||||||||||||
501   TFSHYYYMILSRGQIVFMNREPKRTLTSVSVFVDHHLAPSFYFVAFYYHG  550

551   DHPVANSLRVDVQAGACEGKLELSVDGAKQYRNGESVKLHLETDSLALVA  600
      ||||||||||||||||||||||||||||||||||||||||||||||||||
551   DHPVANSLRVDVQAGACEGKLELSVDGAKQYRNGESVKLHLETDSLALVA  600

601   LGALDTALYAAGSKSHKPLNMGKVFEAMNSYDLGCGPGGGDSALQVFQAA  650
      ||||||||||||||||||||||||||||||||||||||||||||||||||
601   LGALDTALYAAGSKSHKPLNMGKVFEAMNSYDLGCGPGGGDSALQVFQAA  650

651   GLAFSDGDQWTLSRKRLSCPKEKTTRKKRNVNFQKAINEKLGQYASPTAK  700
      ||||||||||||||||||||||||||||||||||||||||||||||||||
651   GLAFSDGDQWTLSRKRLSCPKEKTTRKKRNVNFQKAINEKLGQYASPTAK  700
```

```
701  RCCQDGVTRLPMMRSCEQRAARVQQPDCREPFLSCCQFAESLRKKSRDKG  750
     |||||||||||||||||||||||||||||||||||||||||||||||||
701  RCCQDGVTRLPMMRSCEQRAARVQQPDCREPFLSCCQFAESLRKKSRDKG  750

751  QAGLQRALEILQEEDLIDEDDIPVRSFFPENWLWRVETVDRFQILTLWLP  800
     |||||||||||||||||||||||||||||||||||||||||||||||||
751  QAGLQRALEILQEEDLIDEDDIPVRSFFPENWLWRVETVDRFQILTLWLP  800

801  DSLTTWEIHGLSLSKTKGLCVATPVQLRVFREFHLHLRLPMSVRRFEQLE  850
     |||||||||||||||||||||||||||||||||||||||||||||||||
801  DSLTTWEIHGLSLSKTKGLCVATPVQLRVFREFHLHLRLPMSVRRFEQLE  850

851  LRPVLYNYLDKNLTVSVHVSPVEGLCLAGGGGLAQQVLVPAGSARPVAFS  900
     |||||||||||||||||||||||||||||||||||||||||||||||||
851  LRPVLYNYLDKNLTVSVHVSPVEGLCLAGGGGLAQQVLVPAGSARPVAFS  900

901  VVPTAAAAVSLKVVARGSFEFPVGDAVSKVLQIEKEGAIHREELVYELNP  950
     |||||||||||||||||||||||||||||||||||||||||||||||||
901  VVPTAAAAVSLKVVARGSFEFPVGDAVSKVLQIEKEGAIHREELVYELNP  950

951  LDHRGRTLEIPGNSDPNMIPDGDFNSYVRVTASDPLDTLGSEGALSPGGV  1000
     |||||||||||||||||||||||||||||||||||||||||||||||||
951  LDHRGRTLEIPGNSDPNMIPDGDFNSYVRVTASDPLDTLGSEGALSPGGV  1000

1001 ASLLRLPRGCGEQTMIYLAPTLAASRYLDKTEQWSTLPPETKDHAVDLIQ  1050
     |||||||||||||||||||||||||||||||||||||||||||||||||
1001 ASLLRLPRGCGEQTMIYLAPTLAASRYLDKTEQWSTLPPETKDHAVDLIQ  1050

1051 KGYMRIQQFRKADGSYAAWLSRDSSTWLTAFVLKVLSLAQEQVGGSPEKL  1100
     |||||||||||||||||||||||||||||||||||||||||||||||||
1051 KGYMRIQQFRKADGSYAAWLSRDSSTWLTAFVLKVLSLAQEQVGGSPEKL  1100

1101 QETSNWLLSQQQADGSFQDPCPVLDRSMQGGLVGNDETVALTAFVTIALH  1150
     |||||||||||||||||||||||||||||||||||||||||||||||||
1101 QETSNWLLSQQQADGSFQDPCPVLDRSMQGGLVGNDETVALTAFVTIALH  1150

1151 HGLAVFQDEGAEPLKQRVEASISKASSFLGEKASAGLLGAHAAAITAYAL  1200
     |||||||||||||||||||||||||||||||||||||||||||||||||
1151 HGLAVFQDEGAEPLKQRVEASISKASSFLGEKASAGLLGAHAAAITAYAL  1200

1201 TLTKAPADLRGVAHNNLMAMAQETGDNLYWGSVTGSQSNAVSPTPAPRNP  1250
     |||||||||||||||||||||||||||||||||||||||||||||||||
1201 TLTKAPADLRGVAHNNLMAMAQETGDNLYWGSVTGSQSNAVSPTPAPRNP  1250

1251 SDPMPQAPALWIETTAYALLHLLLHEGKAEMADQAAAWLTRQGSFQGGFR  1300
     |||||||||||||||||||||||||||||||||||||||||||||||||
1251 SDPMPQAPALWIETTAYALLHLLLHEGKAEMADQAAAWLTRQGSFQGGFR  1300

1301 STQ  1303
     |||
1301 STQ  1303
```

Sequence name: CO4_HUMAN_V1 (SEQ ID NO:389)
Sequence documentation:
Alignment of: HSCOC4_PEA_1_P9 (SEQ ID NO:347) × CO4_HUMAN_V1 (SEQ ID NO:389) . . .
Alignment segment 1/1:
Quality: 14831.00
Escore: 0
Matching length: 1529
Total length: 1529
Matching Percent Similarity: 100.00
Matching Percent Identity: 100.00
Total Percent Similarity: 100.00
Total Percent Identity: 100.00
Gaps: 0
Alignment:

-continued

```
  1 MRLLWGLIWASSFFTLSLQKPRLLLFSPSVVHLGVPLSVGVQLQDVPRGQ   50
    |||||||||||||||||||||||||||||||||||||||||||||||||
  1 MRLLWGLIWASSFFTLSLQKPRLLLFSPSVVHLGVPLSVGVQLQDVPRGQ   50

51 VVKGSVFLRNPSRNNVPCSPKVDFTLSSERDFALLSLQVPLKDAKSCGLH  100
    |||||||||||||||||||||||||||||||||||||||||||||||||
 51 VVKGSVFLRNPSRNNVPCSPKVDFTLSSERDFALLSLQVPLKDAKSCGLH  100

101 QLLRGPEVQLVAHSPWLKDSLSRTTNIQGINLLFSSRRGHLFLQTDQPIY  150
    |||||||||||||||||||||||||||||||||||||||||||||||||
101 QLLRGPEVQLVAHSPWLKDSLSRTTNIQGINLLFSSRRGHLFLQTDQPIY  150

151 NPGQRVRYRVFALDQKMRPSTDTITVMVENSHGLRVRKKEVYMPSSIFQD  200
    |||||||||||||||||||||||||||||||||||||||||||||||||
151 NPGQRVRYRVFALDQKMRPSTDTITVMVENSHGLRVRKKEVYMPSSIFQD  200

201 DFVIPDISEPGTWKISARFSDGLESNSSTQFEVKKYVLPNFEVKITPGKP  250
    |||||||||||||||||||||||||||||||||||||||||||||||||
201 DFVIPDISEPGTWKISARFSDGLESNSSTQFEVKKYVLPNFEVKITPGKP  250

251 YILTVPGHLDEMQLDIQARYIYGKPVQGVAYVRFGLLDEDGKKTFFRGLE  300
    |||||||||||||||||||||||||||||||||||||||||||||||||
251 YILTVPGHLDEMQLDIQARYIYGKPVQGVAYVRFGLLDEDGKKTFFRGLE  300

301 SQTKLVNGQSHISLSKAEFQDALEKLNMGITDLQGLRLYVAAAIIESPGG  350
    |||||||||||||||||||||||||||||||||||||||||||||||||
301 SQTKLVNGQSHISLSKAEFQDALEKLNMGITDLQGLRLYVAAAIIESPGG  350

351 EMEEAELTSWYFVSSPFSLDLSKTKRHLVPGAPFLLQALVREMSGSPASG  400
    |||||||||||||||||||||||||||||||||||||||||||||||||
351 EMEEAELTSWYFVSSPFSLDLSKTKRHLVPGAPFLLQALVREMSGSPASG  400

401 IPVKVSATVSSPGSVPEVQDIQQNTDGSGQVSIPIIIPQTISELQLSVSA  450
    |||||||||||||||||||||||||||||||||||||||||||||||||
401 IPVKVSATVSSPGSVPEVQDIQQNTDGSGQVSIPIIIPQTISELQLSVSA  450

451 GSPHPAIARLTVAAPPSGGPGFLSIERPDSRPPRVGDTLNLNLRAVGSGA  500
    |||||||||||||||||||||||||||||||||||||||||||||||||
451 GSPHPAIARLTVAAPPSGGPGFLSIERPDSRPPRVGDTLNLNLRAVGSGA  500

501 TFSHYYYMILSRGQIVFMNREPKRTLTSVSVFVDHHLAPSFYFVAFYYHG  550
    |||||||||||||||||||||||||||||||||||||||||||||||||
501 TFSHYYYMILSRGQIVFMNREPKRTLTSVSVFVDHHLAPSFYFVAFYYHG  550

551 DHPVANSLRVDVQAGACEGKLELSVDGAKQYRNGESVKLHLETDSLALVA  600
    |||||||||||||||||||||||||||||||||||||||||||||||||
551 DHPVANSLRVDVQAGACEGKLELSVDGAKQYRNGESVKLHLETDSLALVA  600

601 LGALDTALYAAGSKSHKPLNMGKVFEAMNSYDLGCGPGGGDSALQVFQAA  650
    |||||||||||||||||||||||||||||||||||||||||||||||||
601 LGALDTALYAAGSKSHKPLNMGKVFEAMNSYDLGCGPGGGDSALQVFQAA  650

651 GLAFSDGDQWTLSRKRLSCPKEKTTRKKRNVNFQKAINEKLGQYASPTAK  700
    |||||||||||||||||||||||||||||||||||||||||||||||||
651 GLAFSDGDQWTLSRKRLSCPKEKTTRKKRNVNFQKAINEKLGQYASPTAK  700

701 RCCQDGCTRLPMMRSCEQRAARVQQPDCREPFLSCCQFAESLRKKSRDKG  750
    |||||||||||||||||||||||||||||||||||||||||||||||||
701 RCCQDGCTRLPMMRSCEQRAARVQQPDCREPFLSCCQFAESLRKKSRDKG  750

751 QAGLQRALEILQEEDLIDEDDIPVRSFFPENWLWRVETVDRFQILTLWLP  800
    |||||||||||||||||||||||||||||||||||||||||||||||||
751 QAGLQRALEILQEEDLIDEDDIPVRSFFPENWLWRVETVDRFQILTLWLP  800
```

-continued

```
 801  DSLTTWEIHGLSLSKTKGLCVATPVQLRVFREFHLHLRLPMSVRRFEQLE   850
      ||||||||||||||||||||||||||||||||||||||||||||||||||
 801  DSLTTWEIHGLSLSKTKGLCVATPVQLRVFREFHLHLRLPMSVRRFEQLE   850

851  LRPVLYNYLDKNLTVSVHVSPVEGLCLAGGGGLAQQVLVPAGSARPVAFS   900
      ||||||||||||||||||||||||||||||||||||||||||||||||||
 851  LRPVLYNYLDKNLTVSVHVSPVEGLCLAGGGGLAQQVLVPAGSARPVAFS   900

901  VVPTAAAAVSLKVVARGSFEFPVGDAVSKVLQIEKEGAIHREELVYELNP   950
      ||||||||||||||||||||||||||||||||||||||||||||||||||
 901  VVPTAAAAVSLKVVARGSFEFPVGDAVSKVLQIEKEGAIHREELVYELNP   950

951  LDHRGRTLEIPGNSDPNMIPDGDFNSYVRVTASDPLDTLGSEGALSPGGV  1000
      ||||||||||||||||||||||||||||||||||||||||||||||||||
 951  LDHRGRTLEIPGNSDPNMIPDGDFNSYVRVTASDPLDTLGSEGALSPGGV  1000

1001  ASLLRLPRGCGEQTMIYLAPTLAASRYLDKTEQWSTLPPETKDHAVDLIQ  1050
      ||||||||||||||||||||||||||||||||||||||||||||||||||
1001  ASLLRLPRGCGEQTMIYLAPTLAASRYLDKTEQWSTLPPETKDHAVDLIQ  1050

1051  KGYMRIQQFRKADGSYAAWLSRDSSTWLTAFVLKVLSLAQEQVGGSPEKL  1100
      ||||||||||||||||||||||||||||||||||||||||||||||||||
1051  KGYMRIQQFRKADGSYAAWLSRDSSTWLTAFVLKVLSLAQEQVGGSPEKL  1100

1101  QETSNWLLSQQQADGSFQDPCPVLDRSMQGGLVGNDETVALTAFVTIALH  1150
      ||||||||||||||||||||||||||||||||||||||||||||||||||
1101  QETSNWLLSQQQADGSFQDPCPVLDRSMQGGLVGNDETVALTAFVTIALH  1150

1151  HGLAVFQDEGAEPLKQRVEASISKASSFLGEKASAGLLGAHAAAITAYAL  1200
      ||||||||||||||||||||||||||||||||||||||||||||||||||
1151  HGLAVFQDEGAEPLKQRVEASISKASSFLGEKASAGLLGAHAAAITAYAL  1200

1201  TLTKAPADLRGVAHNNLMAMAQETGDNLYWGSVTGSQSNAVSPTPAPRNP  1250
      ||||||||||||||||||||||||||||||||||||||||||||||||||
1201  TLTKAPADLRGVAHNNLMAMAQETGDNLYWGSVTGSQSNAVSPTPAPRNP  1250

1251  SDPMPQAPALWIETTAYALLHLLLHEGKAEMADQAAAWLTRQGSFQGGFR  1300
      ||||||||||||||||||||||||||||||||||||||||||||||||||
1251  SDPMPQAPALWIETTAYALLHLLLHEGKAEMADQAAAWLTRQGSFQGGFR  1300

1301  STQDTVIALDALSAYWIASHTTEERGLNVTLSSTGRNGFKSHALQLNNRQ  1350
      ||||||||||||||||||||||||||||||||||||||||||||||||||
1301  STQDTVIALDALSAYWIASHTTEERGLNVTLSSTGRNGFKSHALQLNNRQ  1350

1351  IRGLEEELQFSLGSKINVKVGGNSKGTLKVLRTYNVLDMKNTTCQDLQIE  1400
      ||||||||||||||||||||||||||||||||||||||||||||||||||
1351  IRGLEEELQFSLGSKINVKVGGNSKGTLKVLRTYNVLDMKNTTCQDLQIE  1400

1401  VTVKGHVEYTMEANEDYEDYEYDELPAKDDPDAPLQPVTPLQLFEGRRNR  1450
      ||||||||||||||||||||||||||||||||||||||||||||||||||
1401  VTVKGHVEYTMEANEDYEDYEYDELPAKDDPDAPLQPVTPLQLFEGRRNR  1450

1451  RRREAPKVVEEQESRVHYTVCIWRNGKVGLSGMAIADVTLLSGFHALRAD  1500
      ||||||||||||||||||||||||||||||||||||||||||||||||||
1451  RRREAPKVVEEQESRVHYTVCIWRNGKVGLSGMAIADVTLLSGFHALRAD  1500

1501  LEKLTSLSDRYVSHFETEGPHVLLYFDSV                      1529
      |||||||||||||||||||||||||||||
1501  LEKLTSLSDRYVSHFETEGPHVLLYFDSV                      1529
```

Sequence name: CO4_HUMAN_V1 (SEQ ID NO:389)
Sequence documentation:
Alignment of: HSCOC4_PEA_1_P22 (SEQ ID NO:348) × CO4_HUMAN_V1 (SEQ ID NO:389) . . .
Alignment segment 1/1:

-continued

Quality: 16066.00
Escore: 0
Matching length: 1654
Total length: 1654
Matching Percent Similarity: 100.00
Matching Percent Identity: 99.94
Total Percent Similarity: 100.00
Total Percent Identity: 99.94
Gaps: 0
Alignment:

```
  1  MRLLWGLIWASSFFTLSLQKPRLLLFSPSVVHLGVPLSVGVQLQDVPRGQ   50
     ||||||||||||||||||||||||||||||||||||||||||||||||||
  1  MRLLWGLIWASSFFTLSLQKPRLLLFSPSVVHLGVPLSVGVQLQDVPRGQ   50

51  VVKGSVFLRNPSRNNVPCSPKVDFTLSSERDFALLSLQVPLKDAKSCGLH  100
     ||||||||||||||||||||||||||||||||||||||||||||||||||
 51  VVKGSVFLRNPSRNNVPCSPKVDFTLSSERDFALLSLQVPLKDAKSCGLH  100

101  QLLRGPEVQLVAHSPWLKDSLSRTTNIQGINLLFSSRRGHLFLQTDQPIY  150
     ||||||||||||||||||||||||||||||||||||||||||||||||||
101  QLLRGPEVQLVAHSPWLKDSLSRTTNIQGINLLFSSRRGHLFLQTDQPIY  150

151  NPGQRVRYRVFALDQKMRPSTDTITVMVENSHGLRVRKKEVYMPSSIFQD  200
     ||||||||||||||||||||||||||||||||||||||||||||||||||
151  NPGQRVRYRVFALDQKMRPSTDTITVMVENSHGLRVRKKEVYMPSSIFQD  200

201  DFVIPDISEPGTWKISARFSDGLESNSSTQFEVKKYVLPNFEVKITPGKP  250
     ||||||||||||||||||||||||||||||||||||||||||||||||||
201  DFVIPDISEPGTWKISARFSDGLESNSSTQFEVKKYVLPNFEVKITPGKP  250

251  YILTVPGHLDEMQLDIQARYIYGKPVQGVAYVRFGLLDEDGKKTFFRGLE  300
     ||||||||||||||||||||||||||||||||||||||||||||||||||
251  YILTVPGHLDEMQLDIQARYIYGKPVQGVAYVRFGLLDEDGKKTFFRGLE  300

301  SQTKLVNGQSHISLSKAEFQDALEKLNMGITDLQGLRLYVAAAIIESPGG  350
     ||||||||||||||||||||||||||||||||||||||||||||||||||
301  SQTKLVNGQSHISLSKAEFQDALEKLNMGITDLQGLRLYVAAAIIESPGG  350

351  EMEEAELTSWYFVSSPFSLDLSKTKRHLVPGAPFLLQALVREMSGSPASG  400
     ||||||||||||||||||||||||||||||||||||||||||||||||||
351  EMEEAELTSWYFVSSPFSLDLSKTKRHLVPGAPFLLQALVREMSGSPASG  400

401  IPVKVSATVSSPGSVPEVQDIQQNTDGSGQVSIPIIIPQTISELQLSVSA  450
     ||||||||||||||||||||||||||||||||||||||||||||||||||
401  IPVKVSATVSSPGSVPEVQDIQQNTDGSGQVSIPIIIPQTISELQLSVSA  450

451  GSPHPAIARLTVAAPPSGGPGFLSIERPDSRPPRVGDTLNLNLRAVGSGA  500
     ||||||||||||||||||||||||||||||||||||||||||||||||||
451  GSPHPAIARLTVAAPPSGGPGFLSIERPDSRPPRVGDTLNLNLRAVGSGA  500

501  TFSHYYYMILSRGQIVFMNREPKRTLTSVSVFVDHHLAPSFYFVAFYYHG  550
     ||||||||||||||||||||||||||||||||||||||||||||||||||
501  TFSHYYYMILSRGQIVFMNREPKRTLTSVSVFVDHHLAPSFYFVAFYYHG  550

551  DHPVANSLRVDVQAGACEGKLELSVDGAKQYRNGESVKLHLETDSLALVA  600
     ||||||||||||||||||||||||||||||||||||||||||||||||||
551  DHPVANSLRVDVQAGACEGKLELSVDGAKQYRNGESVKLHLETDSLALVA  600

601  LGALDTALYAAGSKSHKPLNMGKVFEAMNSYDLGCGPGGGDSALQVFQAA  650
     ||||||||||||||||||||||||||||||||||||||||||||||||||
601  LGALDTALYAAGSKSHKPLNMGKVFEAMNSYDLGCGPGGGDSALQVFQAA  650

651  GLAFSDGDQWTLSRKRLSCPKEKTTRKKRNVNFQKAINEKLGQYASPTAK  700
     ||||||||||||||||||||||||||||||||||||||||||||||||||
651  GLAFSDGDQWTLSRKRLSCPKEKTTRKKRNVNFQKAINEKLGQYASPTAK  700
```

```
701  RCCQDGVTRLPMMRSCEQRAARVQQPDCREPFLSCCQFAESLRKKSRDKG  750
     ||||||||||||||||||||||||||||||||||||||||||||||||||
701  RCCQDGVTRLPMMRSCEQRAARVQQPDCREPFLSCCQFAESLRKKSRDKG  750

751  QAGLQRALEILQEEDLIDEDDIPVRSFFPENWLWRVETVDRFQILTLWLP  800
     ||||||||||||||||||||||||||||||||||||||||||||||||||
751  QAGLQRALEILQEEDLIDEDDIPVRSFFPENWLWRVETVDRFQILTLWLP  800

801  DSLTTWEIHGLSLSKTKGLCVATPVQLRVFREFHLHLRLPMSVRRFEQLE  850
     ||||||||||||||||||||||||||||||||||||||||||||||||||
801  DSLTTWEIHGLSLSKTKGLCVATPVQLRVFREFHLHLRLPMSVRRFEQLE  850

851  LRPVLYNYLDKNLTVSVHVSPVEGLCLAGGGGLAQQVLVPAGSARPVAFS  900
     ||||||||||||||||||||||||||||||||||||||||||||||||||
851  LRPVLYNYLDKNLTVSVHVSPVEGLCLAGGGGLAQQVLVPAGSARPVAFS  900

901  VVPTAAAAVSLKVVARGSFEFPVGDAVSKVLQIEKEGAIHREELVYELNP  950
     ||||||||||||||||||||||||||||||||||||||||||||||||||
901  VVPTAAAAVSLKVVARGSFEFPVGDAVSKVLQIEKEGAIHREELVYELNP  950

951  LDHRGRTLEIPGNSDPNMIPDGDFNSYVRVTASDPLDTLGSEGALSPGGV  1000
     ||||||||||||||||||||||||||||||||||||||||||||||||||
951  LDHRGRTLEIPGNSDPNMIPDGDFNSYVRVTASDPLDTLGSEGALSPGGV  1000

1001 ASLLRLPRGCGEQTMIYLAPTLAASRYLDKTEQWSTLPPETKDHAVDLIQ  1050
     ||||||||||||||||||||||||||||||||||||||||||||||||||
1001 ASLLRLPRGCGEQTMIYLAPTLAASRYLDKTEQWSTLPPETKDHAVDLIQ  1050

1051 KGYMRIQQFRKADGSYAAWLSRDSSTWLTAFVLKVLSLAQEQVGGSPEKL  1100
     ||||||||||||||||||||||||||||||||||||||||||||||||||
1051 KGYMRIQQFRKADGSYAAWLSRDSSTWLTAFVLKVLSLAQEQVGGSPEKL  1100

1101 QETSNWLLSQQQADGSFQDPCPVLDRSMQGGLVGNDETVALTAFVTIALH  1150
     ||||||||||||||||||||||||||||||||||||||||||||||||||
1101 QETSNWLLSQQQADGSFQDPCPVLDRSMQGGLVGNDETVALTAFVTIALH  1150

1151 HGLAVFQDEGAEPLKQRVEASISKASSFLGEKASAGLLGAHAAAITAYAL  1200
     ||||||||||||||||||||||||||||||||||||||||||||||||||
1151 HGLAVFQDEGAEPLKQRVEASISKASSFLGEKASAGLLGAHAAAITAYAL  1200

1201 TLTKAPADLRGVAHNNLMAMAQETGDNLYWGSVTGSQSNAVSPTPAPRNP  1250
     ||||||||||||||||||||||||||||||||||||||||||||||||||
1201 TLTKAPADLRGVAHNNLMAMAQETGDNLYWGSVTGSQSNAVSPTPAPRNP  1250

1251 SDPMPQAPALWIETTAYALLHLLLHEGKAEMADQAAAWLTRQGSFQGGFR  1300
     ||||||||||||||||||||||||||||||||||||||||||||||||||
1251 SDPMPQAPALWIETTAYALLHLLLHEGKAEMADQAAAWLTRQGSFQGGFR  1300

1301 STQDTVIALDALSAYWIASHTTEERGLNVTLSSTGRNGFKSHALQLNNRQ  1350
     ||||||||||||||||||||||||||||||||||||||||||||||||||
1301 STQDTVIALDALSAYWIASHTTEERGLNVTLSSTGRNGFKSHALQLNNRQ  1350

1351 IRGLEEELQFSLGSKINVKVGGNSKGTLKVLRTYNVLDMKNTTCQDLQIE  1400
     ||||||||||||||||||||||||||||||||||||||||||||||||||
1351 IRGLEEELQFSLGSKINVKVGGNSKGTLKVLRTYNVLDMKNTTCQDLQIE  1400

1401 VTVKGHVEYTMEANEDYEDYEYDELPAKDDPDAPLQPVTPLQLFEGRRNR  1450
     ||||||||||||||||||||||||||||||||||||||||||||||||||
1401 VTVKGHVEYTMEANEDYEDYEYDELPAKDDPDAPLQPVTPLQLFEGRRNR  1450

1451 RRREAPKVVEEQESRVHYTVCIWRNGKVGLSGMAIADVTLLSGFHALRAD  1500
     ||||||||||||||||||||||||||||||||||||||||||||||||||
1451 RRREAPKVVEEQESRVHYTVCIWRNGKVGLSGMAIADVTLLSGFHALRAD  1500
```

```
1501  LEKLTSLSDRYVSHFETEGPHVLLYFDSVPTSRECVGFEAVQEVPVGLVQ  1550
      ||||||||||||||||||||||||||||||||||||||||||||||||||
1501  LEKLTSLSDRYVSHFETEGPHVLLYFDSVPTSRECVGFEAVQEVPVGLVQ  1550

1551  PASATLYDYYNPERRCSVFYGAPSKSRLLATLCSAEVCQCAEGKCPRQRR  1600
      ||||||||||||||||||||||||||||||||||||||||||||||||||
1551  PASATLYDYYNPERRCSVFYGAPSKSRLLATLCSAEVCQCAEGKCPRQRR  1600

1601  ALERGLQDEDGYRMKFACYYPRVEYGFQVKVLREDSRAAFRLFETKITQV  1650
      ||||||||||||||||||||||||||||||||||||||||||||||||||
1601  ALERGLQDEDGYRMKFACYYPRVEYGFQVKVLREDSRAAFRLFETKITQV  1650

1651  LHFS  1654
      |||:
1651  LHFT  1654
```

Sequence name: CO4_HUMAN_V1 (SEQ ID NO:389)
Sequence documentation:
Alignment of: HSCOC4_PEA_1_P23 (SEQ ID NO:349) × CO4_HUMAN_V1 (SEQ ID NO:389) . . .
Alignment segment 1/1:
Quality: 15806.00
Escore: 0
Matching length: 1626
Total length: 1626
Matching Percent Similarity: 100.00
Matching Percent Identity: 100.00
Total Percent Similarity: 100.00
Total Percent Identity: 100.00
Gaps: 0
Alignment:

```
   1  MRLLWGLIWASSFFTLSLQKPRLLLFSPSVVHLGVPLSVGVQLQDVPRGQ   50
      ||||||||||||||||||||||||||||||||||||||||||||||||||
   1  MRLLWGLIWASSFFTLSLQKPRLLLFSPSVVHLGVPLSVGVQLQDVPRGQ   50

51  VVKGSVFLRNPSRNNVPCSPKVDFTLSSERDFALLSLQVPLKDAKSCGLH  100
      ||||||||||||||||||||||||||||||||||||||||||||||||||
  51  VVKGSVFLRNPSRNNVPCSPKVDFTLSSERDFALLSLQVPLKDAKSCGLH  100

101  QLLRGPEVQLVAHSPWLKDSLSRTTNIQGINLLFSSRRGHLFLQTDQPIY  150
      ||||||||||||||||||||||||||||||||||||||||||||||||||
 101  QLLRGPEVQLVAHSPWLKDSLSRTTNIQGINLLFSSRRGHLFLQTDQPIY  150

151  NPGQRVRYRVFALDQKMRPSTDTITVMVENSHGLRVRKKEVYMPSSIFQD  200
      ||||||||||||||||||||||||||||||||||||||||||||||||||
 151  NPGQRVRYRVFALDQKMRPSTDTITVMVENSHGLRVRKKEVYMPSSIFQD  200

201  DFVIPDISEPGTWKISARFSDGLESNSSTQFEVKKYVLPNFEVKITPGKP  250
      ||||||||||||||||||||||||||||||||||||||||||||||||||
 201  DFVIPDISEPGTWKISARFSDGLESNSSTQFEVKKYVLPNFEVKITPGKP  250

251  YILTVPGHLDEMQLDIQARYIYGKPVQGVAYVRFGLLDEDGKKTFFRGLE  300
      ||||||||||||||||||||||||||||||||||||||||||||||||||
 251  YILTVPGHLDEMQLDIQARYIYGKPVQGVAYVRFGLLDEDGKKTFFRGLE  300

301  SQTKLVNGQSHISLSKAEFQDALEKLNMGITDLQGLRLYVAAAIIESPGG  350
      ||||||||||||||||||||||||||||||||||||||||||||||||||
 301  SQTKLVNGQSHISLSKAEFQDALEKLNMGITDLQGLRLYVAAAIIESPGG  350

351  EMEEAELTSWYFVSSPFSLDLSKTKRHLVPGAPFLLQALVREMSGSPASG  400
      ||||||||||||||||||||||||||||||||||||||||||||||||||
 351  EMEEAELTSWYFVSSPFSLDLSKTKRHLVPGAPFLLQALVREMSGSPASG  400

401  IPVKVSATVSSPGSVPEVQDIQQNTDGSGQVSIPIIIPQTISELQLSVSA  450
      ||||||||||||||||||||||||||||||||||||||||||||||||||
 401  IPVKVSATVSSPGSVPEVQDIQQNTDGSGQVSIPIIIPQTISELQLSVSA  450
```

```
451  GSPHPAIARLTVAAPPSGGPGFLSIERPDSRPPRVGDTLNLNLRAVGSGA  500
     ||||||||||||||||||||||||||||||||||||||||||||||||||
451  GSPHPAIARLTVAAPPSGGPGFLSIERPDSRPPRVGDTLNLNLRAVGSGA  500

501  TFSHYYYMILSRGQIVFMNREPKRTLTSVSVFVDHHLAPSFYFVAFYYHG  550
     ||||||||||||||||||||||||||||||||||||||||||||||||||
501  TFSHYYYMILSRGQIVFMNREPKRTLTSVSVFVDHHLAPSFYFVAFYYHG  550

551  DHPVANSLRVDVQAGACEGKLELSVDGAKQYRNGESVKLHLETDSLALVA  600
     ||||||||||||||||||||||||||||||||||||||||||||||||||
551  DHPVANSLRVDVQAGACEGKLELSVDGAKQYRNGESVKLHLETDSLALVA  600

601  LGALDTALYAAGSKSHKPLNMGKVFEAMNSYDLGCGPGGGDSALQVFQAA  650
     ||||||||||||||||||||||||||||||||||||||||||||||||||
601  LGALDTALYAAGSKSHKPLNMGKVFEAMNSYDLGCGPGGGDSALQVFQAA  650

651  GLAFSDGDQWTLSRKRLSCPKEKTTRKKRNVNFQKAINEKLGQYASPTAK  700
     ||||||||||||||||||||||||||||||||||||||||||||||||||
651  GLAFSDGDQWTLSRKRLSCPKEKTTRKKRNVNFQKAINEKLGQYASPTAK  700

701  RCCQDGVTRLPMMRSCEQRAARVQQPDCREPFLSCCQFAESLRKKSRDKG  750
     ||||||||||||||||||||||||||||||||||||||||||||||||||
701  RCCQDGVTRLPMMRSCEQRAARVQQPDCREPFLSCCQFAESLRKKSRDKG  750

751  QAGLQRALEILQEEDLIDEDDIPVRSFFPENWLWRVETVDRFQILTLWLP  800
     ||||||||||||||||||||||||||||||||||||||||||||||||||
751  QAGLQRALEILQEEDLIDEDDIPVRSFFPENWLWRVETVDRFQILTLWLP  800

801  DSLTTWEIHGLSLSKTKGLCVATPVQLRVFREFHLHLRLPMSVRRFEQLE  850
     ||||||||||||||||||||||||||||||||||||||||||||||||||
801  DSLTTWEIHGLSLSKTKGLCVATPVQLRVFREFHLHLRLPMSVRRFEQLE  850

851  LRPVLYNYLDKNLTVSVHVSPVEGLCLAGGGGLAQQVLVPAGSARPVAFS  900
     ||||||||||||||||||||||||||||||||||||||||||||||||||
851  LRPVLYNYLDKNLTVSVHVSPVEGLCLAGGGGLAQQVLVPAGSARPVAFS  900

901  VVPTAAAAVSLKVVARGSFEFPVGDAVSKVLQIEKEGAIHREELVYELNP  950
     ||||||||||||||||||||||||||||||||||||||||||||||||||
901  VVPTAAAAVSLKVVARGSFEFPVGDAVSKVLQIEKEGAIHREELVYELNP  950

951  LDHRGRTLEIPGNSDPNMIPDGDFNSYVRVTASDPLDTLGSEGALSPGGV  1000
     ||||||||||||||||||||||||||||||||||||||||||||||||||
951  LDHRGRTLEIPGNSDPNMIPDGDFNSYVRVTASDPLDTLGSEGALSPGGV  1000

1001 ASLLRLPRGCGEQTMIYLAPTLAASRYLDKTEQWSTLPPETKDHAVDLIQ  1050
     ||||||||||||||||||||||||||||||||||||||||||||||||||
1001 ASLLRLPRGCGEQTMIYLAPTLAASRYLDKTEQWSTLPPETKDHAVDLIQ  1050

1051 KGYMRIQQFRKADGSYAAWLSRDSSTWLTAFVLKVLSLAQEQVGGSPEKL  1100
     ||||||||||||||||||||||||||||||||||||||||||||||||||
1051 KGYMRIQQFRKADGSYAAWLSRDSSTWLTAFVLKVLSLAQEQVGGSPEKL  1100

1101 QETSNWLLSQQQADGSFQDPCPVLDRSMQGGLVGNDETVALTAFVTIALH  1150
     ||||||||||||||||||||||||||||||||||||||||||||||||||
1101 QETSNWLLSQQQADGSFQDPCPVLDRSMQGGLVGNDETVALTAFVTIALH  1150

1151 HGLAVFQDEGAEPLKQRVEASISKASSFLGEKASAGLLGAHAAAITAYAL  1200
     ||||||||||||||||||||||||||||||||||||||||||||||||||
1151 HGLAVFQDEGAEPLKQRVEASISKASSFLGEKASAGLLGAHAAAITAYAL  1200

1201 TLTKAPADLRGVAHNNLMAMAQETGDNLYWGSVTGSQSNAVSPTPAPRNP  1250
     ||||||||||||||||||||||||||||||||||||||||||||||||||
1201 TLTKAPADLRGVAHNNLMAMAQETGDNLYWGSVTGSQSNAVSPTPAPRNP  1250
```

```
1251  SDPMPQAPALWIETTAYALLHLLLHEGKAEMADQAAAWLTRQGSFQGGFR   1300
      ||||||||||||||||||||||||||||||||||||||||||||||||||
1251  SDPMPQAPALWIETTAYALLHLLLHEGKAEMADQAAAWLTRQGSFQGGFR   1300

1301  STQDTVIALDALSAYWIASHTTEERGLNVTLSSTGRNGFKSHALQLNNRQ   1350
      ||||||||||||||||||||||||||||||||||||||||||||||||||
1301  STQDTVIALDALSAYWIASHTTEERGLNVTLSSTGRNGFKSHALQLNNRQ   1350

1351  IRGLEEELQFSLGSKINVKVGGNSKGTLKVLRTYNVLDMKNTTCQDLQIE   1400
      ||||||||||||||||||||||||||||||||||||||||||||||||||
1351  IRGLEEELQFSLGSKINVKVGGNSKGTLKVLRTYNVLDMKNTTCQDLQIE   1400

1401  VTVKGHVEYTMEANEDYEDYEYDELPAKDDPDAPLQPVTPLQLFEGRRNR   1450
      ||||||||||||||||||||||||||||||||||||||||||||||||||
1401  VTVKGHVEYTMEANEDYEDYEYDELPAKDDPDAPLQPVTPLQLFEGRRNR   1450

1451  RRREAPKVVEEQESRVHYTVCIWRNGKVGLSGMAIADVTLLSGFHALRAD   1500
      ||||||||||||||||||||||||||||||||||||||||||||||||||
1451  RRREAPKVVEEQESRVHYTVCIWRNGKVGLSGMAIADVTLLSGFHALRAD   1500

1501  LEKLTSLSDRYVSHFETEGPHVLLYFDSVPTSRECVGFEAVQEVPVGLVQ   1550
      ||||||||||||||||||||||||||||||||||||||||||||||||||
1501  LEKLTSLSDRYVSHFETEGPHVLLYFDSVPTSRECVGFEAVQEVPVGLVQ   1550

1551  PASATLYDYYNPERRCSVFYGAPSKSRLLATLCSAEVCQCAEGKCPRQRR   1600
      ||||||||||||||||||||||||||||||||||||||||||||||||||
1551  PASATLYDYYNPERRCSVFYGAPSKSRLLATLCSAEVCQCAEGKCPRQRR   1600

1601  ALERGLQDEDGYRMKFACYYPRVEYG                          1626
      ||||||||||||||||||||||||||
1601  ALERGLQDEDGYRMKFACYYPRVEYG                          1626
```

Sequence name: CO4_HUMAN_V1 (SEQ ID NO:389)
Sequence documentation:
Alignment of: HSCOC4_PEA_1_P24 (SEQ ID NO:350) × CO4_HUMAN_V1 (SEQ ID NO:389) . . .
Alignment segment 1/1:
Quality: 14823.00
Escore: 0
Matching length: 1528
Total length: 1528
Matching Percent Similarity: 100.00
Matching Percent Identity: 100.00
Total Percent Similarity: 100.00
Total Percent Identity: 100.00
Gaps: 0
Alignment:

```
   1  MRLLWGLIWASSFFTLSLQKPRLLLFSPSVVHLGVPLSVGVQLQDVPRGQ   50
      ||||||||||||||||||||||||||||||||||||||||||||||||||
   1  MRLLWGLIWASSFFTLSLQKPRLLLFSPSVVHLGVPLSVGVQLQDVPRGQ   50

51  VVKGSVFLRNPSRNNVPCSPKVDFTLSSERDFALLSLQVPLKDAKSCGLH   100
      ||||||||||||||||||||||||||||||||||||||||||||||||||
  51  VVKGSVFLRNPSRNNVPCSPKVDFTLSSERDFALLSLQVPLKDAKSCGLH   100

101  QLLRGPEVQLVAHSPWLKDSLSRTTNIQGINLLFSSRRGHLFLQTDQPIY   150
      ||||||||||||||||||||||||||||||||||||||||||||||||||
 101  QLLRGPEVQLVAHSPWLKDSLSRTTNIQGINLLFSSRRGHLFLQTDQPIY   150

151  NPGQRVRYRVFALDQKMRPSTDTITVMVENSHGLRVRKKEVYMPSSIFQD   200
      ||||||||||||||||||||||||||||||||||||||||||||||||||
 151  NPGQRVRYRVFALDQKMRPSTDTITVMVENSHGLRVRKKEVYMPSSIFQD   200
```

```
201 DFVIPDISEPGTWKISARFSDGLESNSSTQFEVKKYVLPNFEVKITPGKP 250
    |||||||||||||||||||||||||||||||||||||||||||||||||
201 DFVIPDISEPGTWKISARFSDGLESNSSTQFEVKKYVLPNFEVKITPGKP 250

251 YILTVPGHLDEMQLDIQARYIYGKPVQGVAYVRFGLLDEDGKKTFFRGLE 300
    |||||||||||||||||||||||||||||||||||||||||||||||||
251 YILTVPGHLDEMQLDIQARYIYGKPVQGVAYVRFGLLDEDGKKTFFRGLE 300

301 SQTKLVNGQSHISLSKAEFQDALEKLNMGITDLQGLRLYVAAAIIESPGG 350
    |||||||||||||||||||||||||||||||||||||||||||||||||
301 SQTKLVNGQSHISLSKAEFQDALEKLNMGITDLQGLRLYVAAAIIESPGG 350

351 EMEEAELTSWYFVSSPFSLDLSKTKRHLVPGAPFLLQALVREMSGSPASG 400
    |||||||||||||||||||||||||||||||||||||||||||||||||
351 EMEEAELTSWYFVSSPFSLDLSKTKRHLVPGAPFLLQALVREMSGSPASG 400

401 IPVKVSATVSSPGSVPEVQDIQQNTDGSGQVSIPIIIPQTISELQLSVSA 450
    |||||||||||||||||||||||||||||||||||||||||||||||||
401 IPVKVSATVSSPGSVPEVQDIQQNTDGSGQVSIPIIIPQTISELQLSVSA 450

451 GSPHPAIARLTVAAPPSGGPGFLSIERPDSRPPRVGDTLNLNLRAVGSGA 500
    |||||||||||||||||||||||||||||||||||||||||||||||||
451 GSPHPAIARLTVAAPPSGGPGFLSIERPDSRPPRVGDTLNLNLRAVGSGA 500

501 TFSHYYYMILSRGQIVFMNREPKRTLTSVSVFVDHHLAPSFYFVAFYYHG 550
    |||||||||||||||||||||||||||||||||||||||||||||||||
501 TFSHYYYMILSRGQIVFMNREPKRTLTSVSVFVDHHLAPSFYFVAFYYHG 550

551 DHPVANSLRVDVQAGACEGKLELSVDGAKQYRNGESVKLHLETDSLALVA 600
    |||||||||||||||||||||||||||||||||||||||||||||||||
551 DHPVANSLRVDVQAGACEGKLELSVDGAKQYRNGESVKLHLETDSLALVA 600

601 LGALDTALYAAGSKSHKPLNMGKVFEAMNSYDLGCGPGGGDSALQVFQAA 650
    |||||||||||||||||||||||||||||||||||||||||||||||||
601 LGALDTALYAAGSKSHKPLNMGKVFEAMNSYDLGCGPGGGDSALQVFQAA 650

651 GLAFSDGDQWTLSRKRLSCPKEKTTRKKRNVNFQKAINEKLGQYASPTAK 700
    |||||||||||||||||||||||||||||||||||||||||||||||||
651 GLAFSDGDQWTLSRKRLSCPKEKTTRKKRNVNFQKAINEKLGQYASPTAK 700

701 RCCQDGVTRLPMMRSCEQRAARVQQPDCREPFLSCCQFAESLRKKSRDKG 750
    |||||||||||||||||||||||||||||||||||||||||||||||||
701 RCCQDGVTRLPMMRSCEQRAARVQQPDCREPFLSCCQFAESLRKKSRDKG 750

751 QAGLQRALEILQEEDLIDEDDIPVRSFFPENWLWRVETVDRFQILTLWLP 800
    |||||||||||||||||||||||||||||||||||||||||||||||||
751 QAGLQRALEILQEEDLIDEDDIPVRSFFPENWLWRVETVDRFQILTLWLP 800

801 DSLTTWEIHGLSLSKTKGLCVATPVQLRVFREFHLHLRLPMSVRRFEQLE 850
    |||||||||||||||||||||||||||||||||||||||||||||||||
801 DSLTTWEIHGLSLSKTKGLCVATPVQLRVFREFHLHLRLPMSVRRFEQLE 850

851 LRPVLYNYLDKNLTVSVHVSPVEGLCLAGGGGLAQQVLVPAGSARPVAFS 900
    |||||||||||||||||||||||||||||||||||||||||||||||||
851 LRPVLYNYLDKNLTVSVHVSPVEGLCLAGGGGLAQQVLVPAGSARPVAFS 900

901 VVPTAAAAVSLKVVARGSFEFPVGDAVSKVLQIEKEGAIHREELVYELNP 950
    |||||||||||||||||||||||||||||||||||||||||||||||||
901 VVPTAAAAVSLKVVARGSFEFPVGDAVSKVLQIEKEGAIHREELVYELNP 950

951 LDHRGRTLEIPGNSDPNMIPDGDFNSYVRVTASDPLDTLGSEGALSPGGV 1000
    |||||||||||||||||||||||||||||||||||||||||||||||||
951 LDHRGRTLEIPGNSDPNMIPDGDFNSYVRVTASDPLDTLGSEGALSPGGV 1000
```

```
1001  ASLLRLPRGCGEQTMIYLAPTLAASRYLDKTEQWSTLPPETKDHAVDLIQ  1050
      ||||||||||||||||||||||||||||||||||||||||||||||||||
1001  ASLLRLPRGCGEQTMIYLAPTLAASRYLDKTEQWSTLPPETKDHAVDLIQ  1050

1051  KGYMRIQQFRKADGSYAAWLSRDSSTWLTAFVLKVLSLAQEQVGGSPEKL  1100
      ||||||||||||||||||||||||||||||||||||||||||||||||||
1051  KGYMRIQQFRKADGSYAAWLSRDSSTWLTAFVLKVLSLAQEQVGGSPEKL  1100

1101  QETSNWLLSQQQADGSFQDPCPVLDRSMQGGLVGNDETVALTAFVTIALH  1150
      ||||||||||||||||||||||||||||||||||||||||||||||||||
1101  QETSNWLLSQQQADGSFQDPCPVLDRSMQGGLVGNDETVALTAFVTIALH  1150

1151  HGLAVFQDEGAEPLKQRVEASISKASSFLGEKASAGLLGAHAAAITAYAL  1200
      ||||||||||||||||||||||||||||||||||||||||||||||||||
1151  HGLAVFQDEGAEPLKQRVEASISKASSFLGEKASAGLLGAHAAAITAYAL  1200

1201  TLTKAPADLRGVAHNNLMAMAQETGDNLYWGSVTGSQSNAVSPTPAPRNP  1250
      ||||||||||||||||||||||||||||||||||||||||||||||||||
1201  TLTKAPADLRGVAHNNLMAMAQETGDNLYWGSVTGSQSNAVSPTPAPRNP  1250

1251  SDPMPQAPALWIETTAYALLHLLLHEGKAEMADQAAAWLTRQGSFQGGFR  1300
      ||||||||||||||||||||||||||||||||||||||||||||||||||
1251  SDPMPQAPALWIETTAYALLHLLLHEGKAEMADQAAAWLTRQGSFQGGFR  1300

1301  STQDTVIALDALSAYWIASHTTEERGLNVTLSSTGRNGFKSHALQLNNRQ  1350
      ||||||||||||||||||||||||||||||||||||||||||||||||||
1301  STQDTVIALDALSAYWIASHTTEERGLNVTLSSTGRNGFKSHALQLNNRQ  1350

1351  IRGLEEELQFSLGSKINVKVGGVNKGTLKVLRTYNVLDMKNTTCQDLQIE  1400
      ||||||||||||||||||||||||||||||||||||||||||||||||||
1351  IRGLEEELQFSLGSKINVKVGGVNKGTLKVLRTYNVLDMKNTTCQDLQIE  1400

1401  VTVKGHVEYTMEANEDYEDYEYDELPAKDDPDAPLQPVTPLQLFEGRRNR  1450
      ||||||||||||||||||||||||||||||||||||||||||||||||||
1401  VTVKGHVEYTMEANEDYEDYEYDELPAKDDPDAPLQPVTPLQLFEGRRNR  1450

1451  RRREAPKVVEEQESRVHYTVCIWRNGKVGLSGMAIADVTLLSGFHALRAD  1500
      ||||||||||||||||||||||||||||||||||||||||||||||||||
1451  RRREAPKVVEEQESRVHYTVCIWRNGKVGLSGMAIADVTLLSGFHALRAD  1500

1501  LEKLTSLSDRYVSHFETEGPHVLLYFDS                       1528
      ||||||||||||||||||||||||||||
1501  LEKLTSLSDRYVSHFETEGPHVLLYFDS                       1528
```

Sequence name: CO4_HUMAN_V1 (SEQ ID NQ:389)
Sequence documentation:
Alignment of: HSCOC4_PEA_1_P25 (SEQ ID NO:351) × CO4_HUMAN_V1 (SEQ ID NO:389) . . .
Alignment segment 1/1:
Quality: 15464.00
Escore: 0
Matching length: 1593
Total length: 1593
Matching Percent Similarity: 100.00
Matching Percent Identity: 100.00
Total Percent Similarity: 100.00
Total Percent Identity: 100.00
Gaps: 0
Alignment:

```
   1  MRLLWGLIWASSFFTLSLQKPRLLLFSPSVVHLGVPLSVGVQLQDVPRGQ  50
      ||||||||||||||||||||||||||||||||||||||||||||||||||
   1  MRLLWGLIWASSFFTLSLQKPRLLLFSPSVVHLGVPLSVGVQLQDVPRGQ  50

51  VVKGSVFLRNPSRNNVPCSPKVDFTLSSERDFALLSLQVPLKDAKSCGLH  100
      ||||||||||||||||||||||||||||||||||||||||||||||||||
  51  VVKGSVFLRNPSRNNVPCSPKVDFTLSSERDFALLSLQVPLKDAKSCGLH  100
```

```
101  QLLRGPEVQLVAHSPWLKDSLSRTTNIQGINLLFSSRRGHLFLQTDQPIY  150
     ||||||||||||||||||||||||||||||||||||||||||||||||||
101  QLLRGPEVQLVAHSPWLKDSLSRTTNIQGINLLFSSRRGHLFLQTDQPIY  150

151  NPGQRVRYRVFALDQKMRPSTDTITVMVENSHGLRVRKKEVYMPSSIFQD  200
     ||||||||||||||||||||||||||||||||||||||||||||||||||
151  NPGQRVRYRVFALDQKMRPSTDTITVMVENSHGLRVRKKEVYMPSSIFQD  200

201  DFVIPDISEPGTWKISARFSDGLESNSSTQFEVKKYVLPNFEVKITPGKP  250
     ||||||||||||||||||||||||||||||||||||||||||||||||||
201  DFVIPDISEPGTWKISARFSDGLESNSSTQFEVKKYVLPNFEVKITPGKP  250

251  YILTVPGHLDEMQLDIQARYIYGKPVQGVAYVRFGLLDEDGKKTFFRGLE  300
     ||||||||||||||||||||||||||||||||||||||||||||||||||
251  YILTVPGHLDEMQLDIQARYIYGKPVQGVAYVRFGLLDEDGKKTFFRGLE  300

301  SQTKLVNGQSHISLSKAEFQDALEKLNMGITDLQGLRLYVAAAIIESPGG  350
     ||||||||||||||||||||||||||||||||||||||||||||||||||
301  SQTKLVNGQSHISLSKAEFQDALEKLNMGITDLQGLRLYVAAAIIESPGG  350

351  EMEEAELTSWYFVSSPFSLDLSKTKRHLVPGAPFLLQALVREMSGSPASG  400
     ||||||||||||||||||||||||||||||||||||||||||||||||||
351  EMEEAELTSWYFVSSPFSLDLSKTKRHLVPGAPFLLQALVREMSGSPASG  400

401  IPVKVSATVSSPGSVPEVQDIQQNTDGSGQVSIPIIIPQTISELQLSVSA  450
     ||||||||||||||||||||||||||||||||||||||||||||||||||
401  IPVKVSATVSSPGSVPEVQDIQQNTDGSGQVSIPIIIPQTISELQLSVSA  450

451  GSPHPAIARLTVAAPPSGGPGFLSIERPDSRPPRVGDTLNLNLRAVGSGA  500
     ||||||||||||||||||||||||||||||||||||||||||||||||||
451  GSPHPAIARLTVAAPPSGGPGFLSIERPDSRPPRVGDTLNLNLRAVGSGA  500

501  TFSHYYYMILSRGQIVFMNREPKRTLTSVSVFVDHHLAPSFYFVAFYYHG  550
     ||||||||||||||||||||||||||||||||||||||||||||||||||
501  TFSHYYYMILSRGQIVFMNREPKRTLTSVSVFVDHHLAPSFYFVAFYYHG  550

551  DHPVANSLRVDVQAGACEGKLELSVDGAKQYRNGESVKLHLETDSLALVA  600
     ||||||||||||||||||||||||||||||||||||||||||||||||||
551  DHPVANSLRVDVQAGACEGKLELSVDGAKQYRNGESVKLHLETDSLALVA  600

601  LGALDTALYAAGSKSHKPLNMGKVFEAMNSYDLGCGPGGGDSALQVFQAA  650
     ||||||||||||||||||||||||||||||||||||||||||||||||||
601  LGALDTALYAAGSKSHKPLNMGKVFEAMNSYDLGCGPGGGDSALQVFQAA  650

651  GLAFSDGDQWTLSRKRLSCPKEKTTRKKRNVNFQKAINEKLGQYASPTAK  700
     ||||||||||||||||||||||||||||||||||||||||||||||||||
651  GLAFSDGDQWTLSRKRLSCPKEKTTRKKRNVNFQKAINEKLGQYASPTAK  700

701  RCCQDGVTRLPMMRSCEQRAARVQQPDCREPFLSCCQFAESLRKKSRDKG  750
     ||||||||||||||||||||||||||||||||||||||||||||||||||
701  RCCQDGVTRLPMMRSCEQRAARVQQPDCREPFLSCCQFAESLRKKSRDKG  750

751  QAGLQRALEILQEEDLIDEDDIPVRSFFPENWLWRVETVDRFQILTLWLP  800
     ||||||||||||||||||||||||||||||||||||||||||||||||||
751  QAGLQRALEILQEEDLIDEDDIPVRSFFPENWLWRVETVDRFQILTLWLP  800

801  DSLTTWEIHGLSLSKTKGLCVATPVQLRVFREFHLHLRLPMSVRRFEQLE  850
     ||||||||||||||||||||||||||||||||||||||||||||||||||
801  DSLTTWEIHGLSLSKTKGLCVATPVQLRVFREFHLHLRLPMSVRRFEQLE  850

851  LRPVLYNYLDKNLTVSVHVSPVEGLCLAGGGGLAQQVLVPAGSARPVAFS  900
     ||||||||||||||||||||||||||||||||||||||||||||||||||
851  LRPVLYNYLDKNLTVSVHVSPVEGLCLAGGGGLAQQVLVPAGSARPVAFS  900
```

```
 901  VVPTAAAAVSLKVVARGSFEFPVGDAVSKVLQIEKEGAIHREELVYELNP   950
      ||||||||||||||||||||||||||||||||||||||||||||||||||
 901  VVPTAAAAVSLKVVARGSFEFPVGDAVSKVLQIEKEGAIHREELVYELNP   950

951  LDHRGRTLEIPGNSDPNMIPDGDFNSYVRVTASDPLDTLGSEGALSPGGV  1000
      ||||||||||||||||||||||||||||||||||||||||||||||||||
 951  LDHRGRTLEIPGNSDPNMIPDGDFNSYVRVTASDPLDTLGSEGALSPGGV  1000

1001  ASLLRLPRGCGEQTMIYLAPTLAASRYLDKTEQWSTLPPETKDHAVDLIQ  1050
      ||||||||||||||||||||||||||||||||||||||||||||||||||
1001  ASLLRLPRGCGEQTMIYLAPTLAASRYLDKTEQWSTLPPETKDHAVDLIQ  1050

1051  KGYMRIQQFRKADGSYAAWLSRDSSTWLTAFVLKVLSLAQEQVGGSPEKL  1100
      ||||||||||||||||||||||||||||||||||||||||||||||||||
1051  KGYMRIQQFRKADGSYAAWLSRDSSTWLTAFVLKVLSLAQEQVGGSPEKL  1100

1101  QETSNWLLSQQQADGSFQDPCPVLDRSMQGGLVGNDETVALTAFVTIALH  1150
      ||||||||||||||||||||||||||||||||||||||||||||||||||
1101  QETSNWLLSQQQADGSFQDPCPVLDRSMQGGLVGNDETVALTAFVTIALH  1150

1151  HGLAVFQDEGAEPLKQRVEASISKASSFLGEKASAGLLGAHAAAITAYAL  1200
      ||||||||||||||||||||||||||||||||||||||||||||||||||
1151  HGLAVFQDEGAEPLKQRVEASISKASSFLGEKASAGLLGAHAAAITAYAL  1200

1201  TLTKAPADLRGVAHNNLMAMAQETGDNLYWGSVTGSQSNAVSPTPAPRNP  1250
      ||||||||||||||||||||||||||||||||||||||||||||||||||
1201  TLTKAPADLRGVAHNNLMAMAQETGDNLYWGSVTGSQSNAVSPTPAPRNP  1250

1251  SDPMPQAPALWIETTAYALLHLLLHEGKAEMADQAAAWLTRQGSFQGGFR  1300
      ||||||||||||||||||||||||||||||||||||||||||||||||||
1251  SDPMPQAPALWIETTAYALLHLLLHEGKAEMADQAAAWLTRQGSFQGGFR  1300

1301  STQDTVIALDALSAYWIASHTTEERGLNVTLSSTGRNGFKSHALQLNNRQ  1350
      ||||||||||||||||||||||||||||||||||||||||||||||||||
1301  STQDTVIALDALSAYWIASHTTEERGLNVTLSSTGRNGFKSHALQLNNRQ  1350

1351  IRGLEEELQFSLGSKINVKVGGNSKGTLKVLRTYNVLDMKNTTCQDLQIE  1400
      ||||||||||||||||||||||||||||||||||||||||||||||||||
1351  IRGLEEELQFSLGSKINVKVGGNSKGTLKVLRTYNVLDMKNTTCQDLQIE  1400

1401  VTVKGHVEYTMEANEDYEDYEYDELPAKDDPDAPLQPVTPLQLFEGRRNR  1450
      ||||||||||||||||||||||||||||||||||||||||||||||||||
1401  VTVKGHVEYTMEANEDYEDYEYDELPAKDDPDAPLQPVTPLQLFEGRRNR  1450

1451  RRREAPKVVEEQESRVHYTVCIWRNGKVGLSGMAIADVTLLSGFHALRAD  1500
      ||||||||||||||||||||||||||||||||||||||||||||||||||
1451  RRREAPKVVEEQESRVHYTVCIWRNGKVGLSGMAIADVTLLSGFHALRAD  1500

1501  LEKLTSLSDRYVSHFETEGPHVLLYFDSVPTSRECVGFEAVQEVPVGLVQ  1550
      ||||||||||||||||||||||||||||||||||||||||||||||||||
1501  LEKLTSLSDRYVSHFETEGPHVLLYFDSVPTSRECVGFEAVQEVPVGLVQ  1550

1551  PASATLYDYYNPERRCSVFYGAPSKSRLLATLCSAEVCQCAEG        1593
      ||||||||||||||||||||||||||||||||||||||||||
1551  PASATLYDYYNPERRCSVFYGAPSKSRLLATLCSAEVCQCAEG        1593
```

Sequence name: CO4_HUMAN_V1 (SEQ ID NO:389)
Sequence documentation:
Alignment of: HSCOC4_PEA_1_P26 (SEQ ID NO:352) × CO4_HUMAN_V1 (SEQ ID NO:389) . . .
Alignment segment 1/1:
Quality: 15464.00
Escore: 0
Matching length: 1593
Total length: 1593

-continued

Matching Percent Similarity: 100.00
Matching Percent Identity: 100.00
Total Percent Similarity: 100.00
Total Percent Identity: 100.00
Gaps: 0
Alignment:

```
  1 MRLLWGLIWASSFFTLSLQKPRLLLFSPSVVHLGVPLSVGVQLQDVPRGQ  50
    ||||||||||||||||||||||||||||||||||||||||||||||||||
  1 MRLLWGLIWASSFFTLSLQKPRLLLFSPSVVHLGVPLSVGVQLQDVPRGQ  50

51 VVKGSVFLRNPSRNNVPCSPKVDFTLSSERDFALLSLQVPLKDAKSCGLH 100
    ||||||||||||||||||||||||||||||||||||||||||||||||||
 51 VVKGSVFLRNPSRNNVPCSPKVDFTLSSERDFALLSLQVPLKDAKSCGLH 100

101 QLLRGPEVQLVAHSPWLKDSLSRTTNIQGINLLFSSRRGHLFLQTDQPIY 150
    ||||||||||||||||||||||||||||||||||||||||||||||||||
101 QLLRGPEVQLVAHSPWLKDSLSRTTNIQGINLLFSSRRGHLFLQTDQPIY 150

151 NPGQRVRYRVFALDQKMRPSTDTITVMVENSHGLRVRKKEVYMPSSIFQD 200
    ||||||||||||||||||||||||||||||||||||||||||||||||||
151 NPGQRVRYRVFALDQKMRPSTDTITVMVENSHGLRVRKKEVYMPSSIFQD 200

201 DFVIPDISEPGTWKISARFSDGLESNSSTQFEVKKYVLPNFEVKITPGKP 250
    ||||||||||||||||||||||||||||||||||||||||||||||||||
201 DFVIPDISEPGTWKISARFSDGLESNSSTQFEVKKYVLPNFEVKITPGKP 250

251 YILTVPGHLDEMQLDIQARYIYGKPVQGVAYVRFGLLDEDGKKTFFRGLE 300
    ||||||||||||||||||||||||||||||||||||||||||||||||||
251 YILTVPGHLDEMQLDIQARYIYGKPVQGVAYVRFGLLDEDGKKTFFRGLE 300

301 SQTKLVNGQSHISLSKAEFQDALEKLNMGITDLQGLRLYVAAAIIESPGG 350
    ||||||||||||||||||||||||||||||||||||||||||||||||||
301 SQTKLVNGQSHISLSKAEFQDALEKLNMGITDLQGLRLYVAAAIIESPGG 350

351 EMEEAELTSWYFVSSPFSLDLSKTKRHLVPGAPFLLQALVREMSGSPASG 400
    ||||||||||||||||||||||||||||||||||||||||||||||||||
351 EMEEAELTSWYFVSSPFSLDLSKTKRHLVPGAPFLLQALVREMSGSPASG 400

401 IPVKVSATVSSPGSVPEVQDIQQNTDGSGQVSIPIIIPQTISELQLSVSA 450
    ||||||||||||||||||||||||||||||||||||||||||||||||||
401 IPVKVSATVSSPGSVPEVQDIQQNTDGSGQVSIPIIIPQTISELQLSVSA 450

451 GSPHPAIARLTVAAPPSGGPGFLSIERPDSRPPRVGDTLNLNLRAVGSGA 500
    ||||||||||||||||||||||||||||||||||||||||||||||||||
451 GSPHPAIARLTVAAPPSGGPGFLSIERPDSRPPRVGDTLNLNLRAVGSGA 500

501 TFSHYYYMILSRGQIVFMNREPKRTLTSVSVFVDHHLAPSFYFVAFYYHG 550
    ||||||||||||||||||||||||||||||||||||||||||||||||||
501 TFSHYYYMILSRGQIVFMNREPKRTLTSVSVFVDHHLAPSFYFVAFYYHG 550

551 DHPVANSLRVDVQAGACEGKLELSVDGAKQYRNGESVKLHLETDSLALVA 600
    ||||||||||||||||||||||||||||||||||||||||||||||||||
551 DHPVANSLRVDVQAGACEGKLELSVDGAKQYRNGESVKLHLETDSLALVA 600

601 LGALDTALYAAGSKSHKPLNMGKVFEAMNSYDLGCGPGGGDSALQVFQAA 650
    ||||||||||||||||||||||||||||||||||||||||||||||||||
601 LGALDTALYAAGSKSHKPLNMGKVFEAMNSYDLGCGPGGGDSALQVFQAA 650

651 GLAFSDGDQWTLSRKRLSCPKEKTTRKKRNVNFQKAINEKLGQYASPTAK 700
    ||||||||||||||||||||||||||||||||||||||||||||||||||
651 GLAFSDGDQWTLSRKRLSCPKEKTTRKKRNVNFQKAINEKLGQYASPTAK 700
```

```
701  RCCQDGVTRLPMMRSCEQRAARVQQPDCREPFLSCCQFAESLRKKSRDKG  750
     ||||||||||||||||||||||||||||||||||||||||||||||||||
701  RCCQDGVTRLPMMRSCEQRAARVQQPDCREPFLSCCQFAESLRKKSRDKG  750

751  QAGLQRALEILQEEDLIDEDDIPVRSFFPENWLWRVETVDRFQILTLWLP  800
     ||||||||||||||||||||||||||||||||||||||||||||||||||
751  QAGLQRALEILQEEDLIDEDDIPVRSFFPENWLWRVETVDRFQILTLWLP  800

801  DSLTTWEIHGLSLSKTKGLCVATPVQLRVFREFHLHLRLPMSVRRFEQLE  850
     ||||||||||||||||||||||||||||||||||||||||||||||||||
801  DSLTTWEIHGLSLSKTKGLCVATPVQLRVFREFHLHLRLPMSVRRFEQLE  850

851  LRPVLYNYLDKNLTVSVHVSPVEGLCLAGGGGLAQQVLVPAGSARPVAFS  900
     ||||||||||||||||||||||||||||||||||||||||||||||||||
851  LRPVLYNYLDKNLTVSVHVSPVEGLCLAGGGGLAQQVLVPAGSARPVAFS  900

901  VVPTAAAAVSLKVVARGSFEFPVGDAVSKVLQIEKEGAIHREELVYELNP  950
     ||||||||||||||||||||||||||||||||||||||||||||||||||
901  VVPTAAAAVSLKVVARGSFEFPVGDAVSKVLQIEKEGAIHREELVYELNP  950

951  LDHRGRTLEIPGNSDPNMIPDGDFNSYVRVTASDPLDTLGSEGALSPGGV  1000
     ||||||||||||||||||||||||||||||||||||||||||||||||||
951  LDHRGRTLEIPGNSDPNMIPDGDFNSYVRVTASDPLDTLGSEGALSPGGV  1000

1001 ASLLRLPRGCGEQTMIYLAPTLAASRYLDKTEQWSTLPPETKDHAVDLIQ  1050
     ||||||||||||||||||||||||||||||||||||||||||||||||||
1001 ASLLRLPRGCGEQTMIYLAPTLAASRYLDKTEQWSTLPPETKDHAVDLIQ  1050

1051 KGYMRIQQFRKADGSYAAWLSRDSSTWLTAFVLKVLSLAQEQVGGSPEKL  1100
     ||||||||||||||||||||||||||||||||||||||||||||||||||
1051 KGYMRIQQFRKADGSYAAWLSRDSSTWLTAFVLKVLSLAQEQVGGSPEKL  1100

1101 QETSNWLLSQQQADGSFQDPCPVLDRSMQGGLVGNDETVALTAFVTIALH  1150
     ||||||||||||||||||||||||||||||||||||||||||||||||||
1101 QETSNWLLSQQQADGSFQDPCPVLDRSMQGGLVGNDETVALTAFVTIALH  1150

1151 HGLAVFQDEGAEPLKQRVEASISKASSFLGEKASAGLLGAHAAAITAYAL  1200
     ||||||||||||||||||||||||||||||||||||||||||||||||||
1151 HGLAVFQDEGAEPLKQRVEASISKASSFLGEKASAGLLGAHAAAITAYAL  1200

1201 TLTKAPADLRGVAHNNLMAMAQETGDNLYWGSVTGSQSNAVSPTPAPRNP  1250
     ||||||||||||||||||||||||||||||||||||||||||||||||||
1201 TLTKAPADLRGVAHNNLMAMAQETGDNLYWGSVTGSQSNAVSPTPAPRNP  1250

1251 SDPMPQAPALWIETTAYALLHLLLHEGKAEMADQAAAWLTRQGSFQGGFR  1300
     ||||||||||||||||||||||||||||||||||||||||||||||||||
1251 SDPMPQAPALWIETTAYALLHLLLHEGKAEMADQAAAWLTRQGSFQGGFR  1300

1301 STQDTVIALDALSAYWIASHTTEERGLNVTLSSTGRNGFKSHALQLNNRQ  1350
     ||||||||||||||||||||||||||||||||||||||||||||||||||
1301 STQDTVIALDALSAYWIASHTTEERGLNVTLSSTGRNGFKSHALQLNNRQ  1350

1351 IRGLEEELQFSLGSKINVKVGGNSKGTLKVLRTYNVLDMKNTTCQDLQIE  1400
     ||||||||||||||||||||||||||||||||||||||||||||||||||
1351 IRGLEEELQFSLGSKINVKVGGNSKGTLKVLRTYNVLDMKNTTCQDLQIE  1400

1401 VTVKGHVEYTMEANEDYEDYEYDELPAKDDPDAPLQPVTPLQLFEGRRNR  1450
     ||||||||||||||||||||||||||||||||||||||||||||||||||
1401 VTVKGHVEYTMEANEDYEDYEYDELPAKDDPDAPLQPVTPLQLFEGRRNR  1450

1451 RRREAPKVVEEQESRVHYTVCIWRNGKVGLSGMAIADVTLLSGFHALRAD  1500
     ||||||||||||||||||||||||||||||||||||||||||||||||||
1451 RRREAPKVVEEQESRVHYTVCIWRNGKVGLSGMAIADVTLLSGFHALRAD  1500
```

```
1501  LEKLTSLSDRYVSHFETEGPHVLLYFDSVPTSRECVGFEAVQEVPVGLVQ  1550
      ||||||||||||||||||||||||||||||||||||||||||||||||||
1501  LEKLTSLSDRYVSHFETEGPHVLLYFDSVPTSRECVGFEAVQEVPVGLVQ  1550

1551  PASATLYDYYNPERRCSVFYGAPSKSRLLATLCSAEVCQCAEG         1593
      ||||||||||||||||||||||||||||||||||||||||||
1551  PASATLYDYYNPERRCSVFYGAPSKSRLLATLCSAEVCQCAEG         1593
```

Sequence name: CO4_HUMAN_V3 (SEQ ID NO:390)
Sequence documentation:
Alignment of: HSCOC4_PEA_1_P30 (SEQ ID NO:353) × CO4_HUMAN_V3 (SEQ ID NO:390) . . .
Alignment segment 1/1:
Quality: 11940.00
Escore: 0
Matching length: 1232
Total length: 1232
Matching Percent Similarity: 100.00
Matching Percent Identity: 100.00
Total Percent Similarity: 100.00
Total Percent Identity: 100.00
Gaps: 0
Alignment:

```
  1   MRLLWGLIWASSFFTLSLQKPRLLLFSPSVVHLGVPLSVGVQLQDVPRGQ   50
      ||||||||||||||||||||||||||||||||||||||||||||||||||
  1   MRLLWGLIWASSFFTLSLQKPRLLLFSPSVVHLGVPLSVGVQLQDVPRGQ   50

51   VVKGSVFLRNPSRNNVPCSPKVDFTLSSERDFALLSLQVPLKDAKSCGLH  100
      ||||||||||||||||||||||||||||||||||||||||||||||||||
 51   VVKGSVFLRNPSRNNVPCSPKVDFTLSSERDFALLSLQVPLKDAKSCGLH  100

101   QLLRGPEVQLVAHSPWLKDSLSRTTNIQGINLLFSSRRGHLFLQTDQPIY  150
      ||||||||||||||||||||||||||||||||||||||||||||||||||
101   QLLRGPEVQLVAHSPWLKDSLSRTTNIQGINLLFSSRRGHLFLQTDQPIY  150

151   NPGQRVRYRVFALDQKMRPSTDTITVMVENSHGLRVRKKEVYMPSSIFQD  200
      ||||||||||||||||||||||||||||||||||||||||||||||||||
151   NPGQRVRYRVFALDQKMRPSTDTITVMVENSHGLRVRKKEVYMPSSIFQD  200

201   DFVIPDISEPGTWKISARFSDGLESNSSTQFEVKKYVLPNFEVKITPGKP  250
      ||||||||||||||||||||||||||||||||||||||||||||||||||
201   DFVIPDISEPGTWKISARFSDGLESNSSTQFEVKKYVLPNFEVKITPGKP  250

251   YILTVPGHLDEMQLDIQARYIYGKPVQGVAYVRFGLLDEDGKKTFFRGLE  300
      ||||||||||||||||||||||||||||||||||||||||||||||||||
251   YILTVPGHLDEMQLDIQARYIYGKPVQGVAYVRFGLLDEDGKKTFFRGLE  300

301   SQTKLVNGQSHISLSKAEFQDALEKLNMGITDLQGLRLYVAAAIIESPGG  350
      ||||||||||||||||||||||||||||||||||||||||||||||||||
301   SQTKLVNGQSHISLSKAEFQDALEKLNMGITDLQGLRLYVAAAIIESPGG  350

351   EMEEAELTSWYFVSSPFSLDLSKTKRHLVPGAPFLLQALVREMSGSPASG  400
      ||||||||||||||||||||||||||||||||||||||||||||||||||
351   EMEEAELTSWYFVSSPFSLDLSKTKRHLVPGAPFLLQALVREMSGSPASG  400

401   IPVKVSATVSSPGSVPEVQDIQQNTDGSGQVSIPIIIPQTISELQLSVSA  450
      ||||||||||||||||||||||||||||||||||||||||||||||||||
401   IPVKVSATVSSPGSVPEVQDIQQNTDGSGQVSIPIIIPQTISELQLSVSA  450

451   GSPHPAIARLTVAAPPSGGPGFLSIERPDSRPPRVGDTLNLNLRAVGSGA  500
      ||||||||||||||||||||||||||||||||||||||||||||||||||
451   GSPHPAIARLTVAAPPSGGPGFLSIERPDSRPPRVGDTLNLNLRAVGSGA  500

501   TFSHYYYMILSRGQIVFMNREPKRTLTSVSVFVDHHLAPSFYFVAFYYHG  550
      ||||||||||||||||||||||||||||||||||||||||||||||||||
501   TFSHYYYMILSRGQIVFMNREPKRTLTSVSVFVDHHLAPSFYFVAFYYHG  550
```

```
551  DHPVANSLRVDVQAGACEGKLELSVDGAKQYRNGESVKLHLETDSLALVA  600
     ||||||||||||||||||||||||||||||||||||||||||||||||||
551  DHPVANSLRVDVQAGACEGKLELSVDGAKQYRNGESVKLHLETDSLALVA  600

601  LGALDTALYAAGSKSHKPLNMGKVFEAMNSYDLGCGPGGGDSALQVFQAA  650
     ||||||||||||||||||||||||||||||||||||||||||||||||||
601  LGALDTALYAAGSKSHKPLNMGKVFEAMNSYDLGCGPGGGDSALQVFQAA  650

651  GLAFSDGDQWTLSRKRLSCPKEKTTRKKRNVNFQKAINEKLGQYASPTAK  700
     ||||||||||||||||||||||||||||||||||||||||||||||||||
651  GLAFSDGDQWTLSRKRLSCPKEKTTRKKRNVNFQKAINEKLGQYASPTAK  700

701  RCCQDGVTRLPMMRSCEQRAARVQQPDCREPFLSCCQFAESLRKKSRDKG  750
     ||||||||||||||||||||||||||||||||||||||||||||||||||
701  RCCQDGVTRLPMMRSCEQRAARVQQPDCREPFLSCCQFAESLRKKSRDKG  750

751  QAGLQRALEILQEEDLIDEDDIPVRSFFPENWLWRVETVDRFQILTLWLP  800
     ||||||||||||||||||||||||||||||||||||||||||||||||||
751  QAGLQRALEILQEEDLIDEDDIPVRSFFPENWLWRVETVDRFQILTLWLP  800

801  DSLTTWEIHGLSLSKTKGLCVATPVQLRVFREFHLHLRLPMSVRRFEQLE  850
     ||||||||||||||||||||||||||||||||||||||||||||||||||
801  DSLTTWEIHGLSLSKTKGLCVATPVQLRVFREFHLHLRLPMSVRRFEQLE  850

851  LRPVLYNYLDKNLTVSVHVSPVEGLCLAGGGGLAQQVLVPAGSARPVAFS  900
     ||||||||||||||||||||||||||||||||||||||||||||||||||
851  LRPVLYNYLDKNLTVSVHVSPVEGLCLAGGGGLAQQVLVPAGSARPVAFS  900

901  VVPTAAAAVSLKVVARGSFEFPVGDAVSKVLQIEKEGAIHREELVYELNP  950
     ||||||||||||||||||||||||||||||||||||||||||||||||||
901  VVPTAAAAVSLKVVARGSFEFPVGDAVSKVLQIEKEGAIHREELVYELNP  950

951  LDHRGRTLEIPGNSDPNMIPDGDFNSYVRVTASDPLDTLGSEGALSPGGV  1000
     ||||||||||||||||||||||||||||||||||||||||||||||||||
951  LDHRGRTLEIPGNSDPNMIPDGDFNSYVRVTASDPLDTLGSEGALSPGGV  1000

1001 ASLLRLPRGCGEQTMIYLAPTLAASRYLDKTEQWSTLPPETKDHAVDLIQ  1050
     ||||||||||||||||||||||||||||||||||||||||||||||||||
1001 ASLLRLPRGCGEQTMIYLAPTLAASRYLDKTEQWSTLPPETKDHAVDLIQ  1050

1051 KGYMRIQQFRKADGSYAAWLSRDSSTWLTAFVLKVLSLAQEQVGGSPEKL  1100
     ||||||||||||||||||||||||||||||||||||||||||||||||||
1051 KGYMRIQQFRKADGSYAAWLSRDSSTWLTAFVLKVLSLAQEQVGGSPEKL  1100

1101 QETSNWLLSQQQADGSFQDPCPVLDRSMQGGLVGNDETVALTAFVTIALH  1150
     ||||||||||||||||||||||||||||||||||||||||||||||||||
1101 QETSNWLLSQQQADGSFQDPCPVLDRSMQGGLVGNDETVALTAFVTIALH  1150

1151 HGLAVFQDEGAEPLKQRVEASISKASSFLGEKASAGLLGAHAAAITAYAL  1200
     ||||||||||||||||||||||||||||||||||||||||||||||||||
1151 HGLAVFQDEGAEPLKQRVEASISKASSFLGEKASAGLLGAHAAAITAYAL  1200

1201 TLTKAPADLRGVAHNNLMAMAQETGDNLYWGS                   1232
     ||||||||||||||||||||||||||||||||
1201 TLTKAPADLRGVAHNNLMAMAQETGDNLYWGS                   1232
```

Sequence name: CO4_HUMAN
Sequence documentation:
Alignment of: HSCOC4_PEA_1_P38 (SEQ ID NO:354) × CO4_HUMAN . . .
Alignment segment 1/1:
Quality: 7969.00
Escore: 0
Matching length: 818
Total length: 818
Matching Percent Similarity: 100.00

Matching Percent Identity: 100.00
Total Percent Similarity: 100.00
Total Percent Identity: 100.00
Gaps: 0
Alignment:

```
  1  MRLLWGLIWASSFFTLSLQKPRLLLFSPSVVHLGVPLSVGVQLQDVPRGQ   50
     ||||||||||||||||||||||||||||||||||||||||||||||||||
  1  MRLLWGLIWASSFFTLSLQKPRLLLFSPSVVHLGVPLSVGVQLQDVPRGQ   50

51  VVKGSVFLRNPSRNNVPCSPKVDFTLSSERDFALLSLQVPLKDAKSCGLH  100
     ||||||||||||||||||||||||||||||||||||||||||||||||||
 51  VVKGSVFLRNPSRNNVPCSPKVDFTLSSERDFALLSLQVPLKDAKSCGLH  100

101  QLLRGPEVQLVAHSPWLKDSLSRTTNIQGINLLFSSRRGHLFLQTDQPIY  150
     ||||||||||||||||||||||||||||||||||||||||||||||||||
101  QLLRGPEVQLVAHSPWLKDSLSRTTNIQGINLLFSSRRGHLFLQTDQPIY  150

151  NPGQRVRYRVFALDQKMRPSTDTITVMVENSHGLRVRKKEVYMPSSIFQD  200
     ||||||||||||||||||||||||||||||||||||||||||||||||||
151  NPGQRVRYRVFALDQKMRPSTDTITVMVENSHGLRVRKKEVYMPSSIFQD  200

201  DFVIPDISEPGTWKISARFSDGLESNSSTQFEVKKYVLPNFEVKITPGKP  250
     ||||||||||||||||||||||||||||||||||||||||||||||||||
201  DFVIPDISEPGTWKISARFSDGLESNSSTQFEVKKYVLPNFEVKITPGKP  250

251  YILTVPGHLDEMQLDIQARYIYGKPVQGVAYVRFGLLDEDGKKTFFRGLE  300
     ||||||||||||||||||||||||||||||||||||||||||||||||||
251  YILTVPGHLDEMQLDIQARYIYGKPVQGVAYVRFGLLDEDGKKTFFRGLE  300

301  SQTKLVNGQSHISLSKAEFQDALEKLNMGITDLQGLRLYVAAAIIESPGG  350
     ||||||||||||||||||||||||||||||||||||||||||||||||||
301  SQTKLVNGQSHISLSKAEFQDALEKLNMGITDLQGLRLYVAAAIIESPGG  350

351  EMEEAELTSWYFVSSPFSLDLSKTKRHLVPGAPFLLQALVREMSGSPASG  400
     ||||||||||||||||||||||||||||||||||||||||||||||||||
351  EMEEAELTSWYFVSSPFSLDLSKTKRHLVPGAPFLLQALVREMSGSPASG  400

401  IPVKVSATVSSPGSVPEVQDIQQNTDGSGQVSIPIIIPQTISELQLSVSA  450
     ||||||||||||||||||||||||||||||||||||||||||||||||||
401  IPVKVSATVSSPGSVPEVQDIQQNTDGSGQVSIPIIIPQTISELQLSVSA  450

451  GSPHPAIARLTVAAPPSGGPGFLSIERPDSRPPRVGDTLNLNLRAVGSGA  500
     ||||||||||||||||||||||||||||||||||||||||||||||||||
451  GSPHPAIARLTVAAPPSGGPGFLSIERPDSRPPRVGDTLNLNLRAVGSGA  500

501  TFSHYYYMILSRGQIVFMNREPKRTLTSVSVFVDHHLAPSFYFVAFYYHG  550
     ||||||||||||||||||||||||||||||||||||||||||||||||||
501  TFSHYYYMILSRGQIVFMNREPKRTLTSVSVFVDHHLAPSFYFVAFYYHG  550

551  DHPVANSLRVDVQAGACEGKLELSVDGAKQYRNGESVKLHLETDSLALVA  600
     ||||||||||||||||||||||||||||||||||||||||||||||||||
551  DHPVANSLRVDVQAGACEGKLELSVDGAKQYRNGESVKLHLETDSLALVA  600

601  LGALDTALYAAGSKSHKPLNMGKVFEAMNSYDLGCGPGGGDSALQVFQAA  650
     ||||||||||||||||||||||||||||||||||||||||||||||||||
601  LGALDTALYAAGSKSHKPLNMGKVFEAMNSYDLGCGPGGGDSALQVFQAA  650

651  GLAFSDGDQWTLSRKRLSCPKEKTTRKKRNVNFQKAINEKLGQYASPTAK  700
     ||||||||||||||||||||||||||||||||||||||||||||||||||
651  GLAFSDGDQWTLSRKRLSCPKEKTTRKKRNVNFQKAINEKLGQYASPTAK  700

701  RCCQDGVTRLPMMRSCEQRAARVQQPDCREPFLSCCQFAESLRKKSRDKG  750
     ||||||||||||||||||||||||||||||||||||||||||||||||||
701  RCCQDGVTRLPMMRSCEQRAARVQQPDCREPFLSCCQFAESLRKKSRDKG  750
```

```
751  QAGLQRALEILQEEDLIDEDDIPVRSFFPENWLWRVETVDRFQILTLWLP  800
     ||||||||||||||||||||||||||||||||||||||||||||||||||
751  QAGLQRALEILQEEDLIDEDDIPVRSFFPENWLWRVETVDRFQILTLWLP  800

801  DSLTTWEIHGLSLSKTKG  818
     ||||||||||||||||||
801  DSLTTWEIHGLSLSKTKG  818
```

Sequence name: CO4_HUMAN
Sequence documentation:
Alignment of: HSCOC4_PEA_1_P39 (SEQ ID NO:355) × CO4_HUMAN . . .
Alignment segment 1/1:
Quality: 3766.00
Escore: 0
Matching length: 387
Total length: 387
Matching Percent Similarity: 100.00
Matching Percent Identity: 100.00
Total Percent Similarity: 100.00
Total Percent Identity: 100.00
Gaps: 0
Alignment:

```
  1  MRLLWGLIWASSFFTLSLQKPRLLLFSPSVVHLGVPLSVGVQLQDVPRGQ   50
     ||||||||||||||||||||||||||||||||||||||||||||||||||
  1  MRLLWGLIWASSFFTLSLQKPRLLLFSPSVVHLGVPLSVGVQLQDVPRGQ   50

51  VVKGSVFLRNPSRNNVPCSPKVDFTLSSERDFALLSLQVPLKDAKSCGLH  100
     ||||||||||||||||||||||||||||||||||||||||||||||||||
 51  VVKGSVFLRNPSRNNVPCSPKVDFTLSSERDFALLSLQVPLKDAKSCGLH  100

101  QLLRGPEVQLVAHSPWLKDSLSRTTNIQGINLLFSSRRGHLFLQTDQPIY  150
     ||||||||||||||||||||||||||||||||||||||||||||||||||
101  QLLRGPEVQLVAHSPWLKDSLSRTTNIQGINLLFSSRRGHLFLQTDQPIY  150

151  NPGQRVRYRVFALDQKMRPSTDTITVMVENSHGLRVRKKEVYMPSSIFQD  200
     ||||||||||||||||||||||||||||||||||||||||||||||||||
151  NPGQRVRYRVFALDQKMRPSTDTITVMVENSHGLRVRKKEVYMPSSIFQD  200

201  DFVIPDISEPGTWKISARFSDGLESNSSTQFEVKKYVLPNFEVKITPGKP  250
     ||||||||||||||||||||||||||||||||||||||||||||||||||
201  DFVIPDISEPGTWKISARFSDGLESNSSTQFEVKKYVLPNFEVKITPGKP  250

251  YILTVPGHLDEMQLDIQARYIYGKPVQGVAYVRFGLLDEDGKKTFFRGLE  300
     ||||||||||||||||||||||||||||||||||||||||||||||||||
251  YILTVPGHLDEMQLDIQARYIYGKPVQGVAYVRFGLLDEDGKKTFFRGLE  300

301  SQTKLVNGQSHISLSKAEFQDALEKLNMGITDLQGLRLYVAAAIIESPGG  350
     ||||||||||||||||||||||||||||||||||||||||||||||||||
301  SQTKLVNGQSHISLSKAEFQDALEKLNMGITDLQGLRLYVAAAIIESPGG  350

351  EMEEAELTSWYFVSSPFSLDLSKTKRHLVPGAPFLLQ  387
     ||||||||||||||||||||||||||||||||||||
351  EMEEAELTSWYFVSSPFSLDLSKTKRHLVPGAPFLLQ  387
```

Sequence name: CO4_HUMAN
Sequence documentation:
Alignment of: HSCOC4_PEA_1_P40 (SEQ ID NO:356) × CO4_HUMAN . . .
Alignment segment 1/1:
Quality: 2309.00
Escore: 0
Matching length: 236
Total length: 236
Matching Percent Similarity: 100.00
Matching Percent Identity: 100.00
Total Percent Similarity: 100.00
Total Percent Identity: 100.00
Gaps: 0
Alignment:

```
  1  MRLLWGLIWASSFFTLSLQKPRLLLFSPSVVHLGVPLSVGVQLQDVPRGQ   50
     ||||||||||||||||||||||||||||||||||||||||||||||||||
  1  MRLLWGLIWASSFFTLSLQKPRLLLFSPSVVHLGVPLSVGVQLQDVPRGQ   50

51  VVKGSVFLRNPSRNNVPCSPKVDFTLSSERDFALLSLQVPLKDAKSCGLH  100
     ||||||||||||||||||||||||||||||||||||||||||||||||||
 51  VVKGSVFLRNPSRNNVPCSPKVDFTLSSERDFALLSLQVPLKDAKSCGLH  100

101  QLLRGPEVQLVAHSPWLKDSLSRTTNIQGINLLFSSRRGHLFLQTDQPIY  150
     ||||||||||||||||||||||||||||||||||||||||||||||||||
101  QLLRGPEVQLVAHSPWLKDSLSRTTNIQGINLLFSSRRGHLFLQTDQPIY  150

151  NPGQRVRYRVFALDQKMRPSTDTITVMVENSHGLRVRKKEVYMPSSIFQD  200
     ||||||||||||||||||||||||||||||||||||||||||||||||||
151  NPGQRVRYRVFALDQKMRPSTDTITVMVENSHGLRVRKKEVYMPSSIFQD  200

201  DFVIPDISEPGTWKISARFSDGLESNSSTQFEVKKY                236
     |||||||||||||||||||||||||||||||||||
201  DFVIPDISEPGTWKISARFSDGLESNSSTQFEVKKY                236
```

Sequence name: CO4_HUMAN_V1 (SEQ ID NO:389)
Sequence documentation:
Alignment of: HSCOC4_PEA_1_P41 (SEQ ID NO:357) × CO4_HUMAN_V1 (SEQ ID NO:389) . . .
Alignment segment 1/1:
Quality: 14831.00
Escore: 0
Matching length: 1529
Total length: 1529
Matching Percent Similarity: 100.00
Matching Percent Identity: 100.00
Total Percent Similarity: 100.00
Total Percent Identity: 100.00
Gaps: 0
Alignment:

```
  1  MRLLWGLIWASSFFTLSLQKPRLLLFSPSVVHLGVPLSVGVQLQDVPRGQ   50
     ||||||||||||||||||||||||||||||||||||||||||||||||||
  1  MRLLWGLIWASSFFTLSLQKPRLLLFSPSVVHLGVPLSVGVQLQDVPRGQ   50

51  VVKGSVFLRNPSRNNVPCSPKVDFTLSSERDFALLSLQVPLKDAKSCGLH  100
     ||||||||||||||||||||||||||||||||||||||||||||||||||
 51  VVKGSVFLRNPSRNNVPCSPKVDFTLSSERDFALLSLQVPLKDAKSCGLH  100

101  QLLRGPEVQLVAHSPWLKDSLSRTTNIQGINLLFSSRRGHLFLQTDQPIY  150
     ||||||||||||||||||||||||||||||||||||||||||||||||||
101  QLLRGPEVQLVAHSPWLKDSLSRTTNIQGINLLFSSRRGHLFLQTDQPIY  150

151  NPGQRVRYRVFALDQKMRPSTDTITVMVENSHGLRVRKKEVYMPSSIFQD  200
     ||||||||||||||||||||||||||||||||||||||||||||||||||
151  NPGQRVRYRVFALDQKMRPSTDTITVMVENSHGLRVRKKEVYMPSSIFQD  200

201  DFVIPDISEPGTWKISARFSDGLESNSSTQFEVKKYVLPNFEVKITPGKP  250
     ||||||||||||||||||||||||||||||||||||||||||||||||||
201  DFVIPDISEPGTWKISARFSDGLESNSSTQFEVKKYVLPNFEVKITPGKP  250

251  YILTVPGHLDEMQLDIQARYIYGKPVQGVAYVRFGLLDEDGKKTFFRGLE  300
     ||||||||||||||||||||||||||||||||||||||||||||||||||
251  YILTVPGHLDEMQLDIQARYIYGKPVQGVAYVRFGLLDEDGKKTFFRGLE  300

301  SQTKLVNGQSHISLSKAEFQDALEKLNMGITDLQGLRLYVAAAIIESPGG  350
     ||||||||||||||||||||||||||||||||||||||||||||||||||
301  SQTKLVNGQSHISLSKAEFQDALEKLNMGITDLQGLRLYVAAAIIESPGG  350
```

```
351  EMEEAELTSWYFVSSPFSLDLSKTKRHLVPGAPFLLQALVREMSGSPASG   400
     ||||||||||||||||||||||||||||||||||||||||||||||||||
351  EMEEAELTSWYFVSSPFSLDLSKTKRHLVPGAPFLLQALVREMSGSPASG   400

401  IPVKVSATVSSPGSVPEVQDIQQNTDGSGQVSIPIIIPQTISELQLSVSA   450
     ||||||||||||||||||||||||||||||||||||||||||||||||||
401  IPVKVSATVSSPGSVPEVQDIQQNTDGSGQVSIPIIIPQTISELQLSVSA   450

451  GSPHPAIARLTVAAPPSGGPGFLSIERPDSRPPRVGDTLNLNLRAVGSGA   500
     ||||||||||||||||||||||||||||||||||||||||||||||||||
451  GSPHPAIARLTVAAPPSGGPGFLSIERPDSRPPRVGDTLNLNLRAVGSGA   500

501  TFSHYYYMILSRGQIVFMNREPKRTLTSVSVFVDHHLAPSFYFVAFYYHG   550
     ||||||||||||||||||||||||||||||||||||||||||||||||||
501  TFSHYYYMILSRGQIVFMNREPKRTLTSVSVFVDHHLAPSFYFVAFYYHG   550

551  DHPVANSLRVDVQAGACEGKLELSVDGAKQYRNGESVKLHLETDSLALVA   600
     ||||||||||||||||||||||||||||||||||||||||||||||||||
551  DHPVANSLRVDVQAGACEGKLELSVDGAKQYRNGESVKLHLETDSLALVA   600

601  LGALDTALYAAGSKSHKPLNMGKVFEAMNSYDLGCGPGGGDSALQVFQAA   650
     ||||||||||||||||||||||||||||||||||||||||||||||||||
601  LGALDTALYAAGSKSHKPLNMGKVFEAMNSYDLGCGPGGGDSALQVFQAA   650

651  GLAFSDGDQWTLSRKRLSCPKEKTTRKKRNVNFQKAINEKLGQYASPTAK   700
     ||||||||||||||||||||||||||||||||||||||||||||||||||
651  GLAFSDGDQWTLSRKRLSCPKEKTTRKKRNVNFQKAINEKLGQYASPTAK   700

701  RCCQDGVTRLPMMRSCEQRAARVQQPDCREPFLSCCQFAESLRKKSRDKG   750
     ||||||||||||||||||||||||||||||||||||||||||||||||||
701  RCCQDGVTRLPMMRSCEQRAARVQQPDCREPFLSCCQFAESLRKKSRDKG   750

751  QAGLQRALEILQEEDLIDEDDIPVRSFFPENWLWRVETVDRFQILTLWLP   800
     ||||||||||||||||||||||||||||||||||||||||||||||||||
751  QAGLQRALEILQEEDLIDEDDIPVRSFFPENWLWRVETVDRFQILTLWLP   800

801  DSLTTWEIHGLSLSKTKGLCVATPVQLRVFREFHLHLRLPMSVRRFEQLE   850
     ||||||||||||||||||||||||||||||||||||||||||||||||||
801  DSLTTWEIHGLSLSKTKGLCVATPVQLRVFREFHLHLRLPMSVRRFEQLE   850

851  LRPVLYNYLDKNLTVSVHVSPVEGLCLAGGGGLAQQVLVPAGSARPVAFS   900
     ||||||||||||||||||||||||||||||||||||||||||||||||||
851  LRPVLYNYLDKNLTVSVHVSPVEGLCLAGGGGLAQQVLVPAGSARPVAFS   900

901  VVPTAAAAVSLKVVARGSFEFPVGDAVSKVLQIEKEGAIHREELVYELNP   950
     ||||||||||||||||||||||||||||||||||||||||||||||||||
901  VVPTAAAAVSLKVVARGSFEFPVGDAVSKVLQIEKEGAIHREELVYELNP   950

951  LDHRGRTLEIPGNSDPNMIPDGDFNSYVRVTASDPLDTLGSEGALSPGGV   1000
     ||||||||||||||||||||||||||||||||||||||||||||||||||
951  LDHRGRTLEIPGNSDPNMIPDGDFNSYVRVTASDPLDTLGSEGALSPGGV   1000

1001 ASLLRLPRGCGEQTMIYLAPTLAASRYLDKTEQWSTLPPETKDHAVDLIQ   1050
     ||||||||||||||||||||||||||||||||||||||||||||||||||
1001 ASLLRLPRGCGEQTMIYLAPTLAASRYLDKTEQWSTLPPETKDHAVDLIQ   1050

1051 KGYMRIQQFRKADGSYAAWLSRDSSTWLTAFVLKVLSLAQEQVGGSPEKL   1100
     ||||||||||||||||||||||||||||||||||||||||||||||||||
1051 KGYMRIQQFRKADGSYAAWLSRDSSTWLTAFVLKVLSLAQEQVGGSPEKL   1100

1101 QETSNWLLSQQQADGSFQDPCPVLDRSMQGGLVGNDETVALTAFVTIALH   1150
     ||||||||||||||||||||||||||||||||||||||||||||||||||
1101 QETSNWLLSQQQADGSFQDPCPVLDRSMQGGLVGNDETVALTAFVTIALH   1150
```

```
1151  HGLAVFQDEGAEPLKQRVEASISKASSFLGEKASAGLLGAHAAAITAYAL  1200
      ||||||||||||||||||||||||||||||||||||||||||||||||||
1151  HGLAVFQDEGAEPLKQRVEASISKASSFLGEKASAGLLGAHAAAITAYAL  1200

1201  TLTKAPADLRGVAHNNLMAMAQETGDNLYWGSVTGSQSNAVSPTPAPRNP  1250
      ||||||||||||||||||||||||||||||||||||||||||||||||||
1201  TLTKAPADLRGVAHNNLMAMAQETGDNLYWGSVTGSQSNAVSPTPAPRNP  1250

1251  SDPMPQAPALWIETTAYALLHLLLHEGKAEMADQAAAWLTRQGSFQGGFR  1300
      ||||||||||||||||||||||||||||||||||||||||||||||||||
1251  SDPMPQAPALWIETTAYALLHLLLHEGKAEMADQAAAWLTRQGSFQGGFR  1300

1301  STQDTVIALDALSAYWIASHTTEERGLNVTLSSTGRNGFKSHALQLNNRQ  1350
      ||||||||||||||||||||||||||||||||||||||||||||||||||
1301  STQDTVIALDALSAYWIASHTTEERGLNVTLSSTGRNGFKSHALQLNNRQ  1350

1351  IRGLEEELQFSLGSKINVKVGGNSKGTLKVLRTYNVLDMKNTTCQDLQIE  1400
      ||||||||||||||||||||||||||||||||||||||||||||||||||
1351  IRGLEEELQFSLGSKINVKVGGNSKGTLKVLRTYNVLDMKNTTCQDLQIE  1400

1401  VTVKGHVEYTMEANEDYEDYEYDELPAKDDPDAPLQPVTPLQLFEGRRNR  1450
      ||||||||||||||||||||||||||||||||||||||||||||||||||
1401  VTVKGHVEYTMEANEDYEDYEYDELPAKDDPDAPLQPVTPLQLFEGRRNR  1450

1451  RRREAPKVVEEQESRVHYTVCIWRNGKVGLSGMAIADVTLLSGFHALRAD  1500
      ||||||||||||||||||||||||||||||||||||||||||||||||||
1451  RRREAPKVVEEQESRVHYTVCIWRNGKVGLSGMAIADVTLLSGFHALRAD  1500

1501  LEKLTSLSDRYVSHFETEGPHVLLYFDSV                      1529
      |||||||||||||||||||||||||||||
1501  LEKLTSLSDRYVSHFETEGPHVLLYFDSV                      1529
```

Sequence name: CO4_HUMAN_V1 (SEQ ID NO:389)
Sequence documentation:
Alignment of: HSCOC4_PEA_1_P42 (SEQ ID NO:358) × CO4_HUMAN_V1 (SEQ ID NO:389) . . .
Alignment segment 1/1:
Quality: 14480.00
Escore: 0
Matching length: 1506
Total length: 1544
Matching Percent Similarity: 99.93
Matching Percent Identity: 99.87
Total Percent Similarity: 97.47
Total Percent Identity: 97.41
Gaps: 1
Alignment:

```
  1  MRLLWGLIWASSFFTLSLQKPRLLLFSPSVVHLGVPLSVGVQLQDVPRGQ   50
     ||||||||||||||||||||||||||||||||||||||||||||||||||
  1  MRLLWGLIWASSFFTLSLQKPRLLLFSPSVVHLGVPLSVGVQLQDVPRGQ   50

51  VVKGSVFLRNPSRNNVPCSPKVDFTLSSERDFALLSLQVPLKDAKSCGLH  100
     ||||||||||||||||||||||||||||||||||||||||||||||||||
 51  VVKGSVFLRNPSRNNVPCSPKVDFTLSSERDFALLSLQVPLKDAKSCGLH  100

101  QLLRGPEVQLVAHSPWLKDSLSRTTNIQGINLLFSSRRGHLFLQTDQPIY  150
     ||||||||||||||||||||||||||||||||||||||||||||||||||
101  QLLRGPEVQLVAHSPWLKDSLSRTTNIQGINLLFSSRRGHLFLQTDQPIY  150

151  NPGQRVRYRVFALDQKMRPSTDTITVMVENSHGLRVRKKEVYMPSSIFQD  200
     ||||||||||||||||||||||||||||||||||||||||||||||||||
151  NPGQRVRYRVFALDQKMRPSTDTITVMVENSHGLRVRKKEVYMPSSIFQD  200
```

```
201  DFVIPDISEPGTWKISARFSDGLESNSSTQFEVKKYVLPNFEVKITPGKP  250
     ||||||||||||||||||||||||||||||||||||||||||||||||||
201  DFVIPDISEPGTWKISARFSDGLESNSSTQFEVKKYVLPNFEVKITPGKP  250

251  YILTVPGHLDEMQLDIQARYIYGKPVQGVAYVRFGLLDEDGKKTFFRGLE  300
     ||||||||||||||||||||||||||||||||||||||||||||||||||
251  YILTVPGHLDEMQLDIQARYIYGKPVQGVAYVRFGLLDEDGKKTFFRGLE  300

301  SQTKLVNGQSHISLSKAEFQDALEKLNMGITDLQGLRLYVAAAIIESPGG  350
     ||||||||||||||||||||||||||||||||||||||||||||||||||
301  SQTKLVNGQSHISLSKAEFQDALEKLNMGITDLQGLRLYVAAAIIESPGG  350

351  EMEEAELTSWYFVSSPFSLDLSKTKRHLVPGAPFLLQALVREMSGSPASG  400
     ||||||||||||||||||||||||||||||||||||||||||||||||||
351  EMEEAELTSWYFVSSPFSLDLSKTKRHLVPGAPFLLQALVREMSGSPASG  400

401  IPVKVSATVSSPGSVPEVQDIQQNTDGSGQVSIPIIIPQTISELQLSVSA  450
     ||||||||||||||||||||||||||||||||||||||||||||||||||
401  IPVKVSATVSSPGSVPEVQDIQQNTDGSGQVSIPIIIPQTISELQLSVSA  450

451  GSPHPAIARLTVAAPPSGGPGFLSIERPDSRPPRVGDTLNLNLRAVGSGA  500
     ||||||||||||||||||||||||||||||||||||||||||||||||||
451  GSPHPAIARLTVAAPPSGGPGFLSIERPDSRPPRVGDTLNLNLRAVGSGA  500

501  TFSHYYYMILSRGQIVFMNREPKRTLTSVSVFVDHHLAPSFYFVAFYYHG  550
     ||||||||||||||||||||||||||||||||||||||||||||||||||
501  TFSHYYYMILSRGQIVFMNREPKRTLTSVSVFVDHHLAPSFYFVAFYYHG  550

551  DHPVANSLRVDVQAGACEGKLELSVDGAKQYRNGESVKLHLETDSLALVA  600
     ||||||||||||||||||||||||||||||||||||||||||||||||||
551  DHPVANSLRVDVQAGACEGKLELSVDGAKQYRNGESVKLHLETDSLALVA  600

601  LGALDTALYAAGSKSHKPLNMGKVFEAMNSYDLGCGPGGGDSALQVFQAA  650
     ||||||||||||||||||||||||||||||||||||||||||||||||||
601  LGALDTALYAAGSKSHKPLNMGKVFEAMNSYDLGCGPGGGDSALQVFQAA  650

651  GLAFSDGDQWTLSRKRLSCPKEKTTRKKRNVNFQKAINEKLGQYASPTAK  700
     ||||||||||||||||||||||||||||||||||||||||||||||||||
651  GLAFSDGDQWTLSRKRLSCPKEKTTRKKRNVNFQKAINEKLGQYASPTAK  700

701  RCCQDGVTRLPMMRSCEQRAARVQQPDCREPFLSCCQFAESLRKKSRDKG  750
     ||||||||||||||||||||||||||||||||||||||||||||||||||
701  RCCQDGVTRLPMMRSCEQRAARVQQPDCREPFLSCCQFAESLRKKSRDKG  750

751  QAGLQRALEILQEEDLIDEDDIPVRSFFPENWLWRVETVDRFQILTLWLP  800
     ||||||||||||||||||||||||||||||||||||||||||||||||||
751  QAGLQRALEILQEEDLIDEDDIPVRSFFPENWLWRVETVDRFQILTLWLP  800

801  DSLTTWEIHGLSLSKTKGLCVATPVQLRVFREFHLHLRLPMSVRRFEQLE  850
     ||||||||||||||||||||||||||||||||||||||||||||||||||
801  DSLTTWEIHGLSLSKTKGLCVATPVQLRVFREFHLHLRLPMSVRRFEQLE  850

851  LRPVLYNYLDKNLTVSVHVSPVEGLCLAGGGGLAQQVLVPAGSARPVAFS  900
     ||||||||||||||||||||||||||||||||||||||||||||||||||
851  LRPVLYNYLDKNLTVSVHVSPVEGLCLAGGGGLAQQVLVPAGSARPVAFS  900

901  VVPTAAAAVSLKVVARGSFEFPVGDAVSKVLQIEKEGAIHREELVYELNP  950
     ||||||||||||||||||||||||||||||||||||||||||||||||||
901  VVPTAAAAVSLKVVARGSFEFPVGDAVSKVLQIEKEGAIHREELVYELNP  950

951  LDHRGRTLEIPGNSDPNMIPDGDFNSYVRVTASDPLDTLGSEGALSPGGV  1000
     ||||||||||||||||||||||||||||||||||||||||||||||||||
951  LDHRGRTLEIPGNSDPNMIPDGDFNSYVRVTASDPLDTLGSEGALSPGGV  1000
```

```
-continued

1001 ASLLRLPRGCGEQTMIYLAPTLAASRYLDKTEQWSTLPPETKDHAVDLIQ 1050
     ||||||||||||||||||||||||||||||||||||||||||||||||||
1001 ASLLRLPRGCGEQTMIYLAPTLAASRYLDKTEQWSTLPPETKDHAVDLIQ 1050

1051 KGYMRIQQFRKADGSYAAWLSRDSSTWLTAFVLKVLSLAQEQVGGSPEKL 1100
     ||||||||||||||||||||||||||||||||||||||||||||||||||
1051 KGYMRIQQFRKADGSYAAWLSRDSSTWLTAFVLKVLSLAQEQVGGSPEKL 1100

1101 QETSNWLLSQQQADGSFQDPCPVLDRSMQGGLVGNDETVALTAFVTIALH 1150
     ||||||||||||||||||||||||||||||||||||||||||||||||||
1101 QETSNWLLSQQQADGSFQDPCPVLDRSMQGGLVGNDETVALTAFVTIALH 1150

1151 HGLAVFQDEGAEPLKQRVEASISKASSFLGEKASAGLLGAHAAAITAYAL 1200
     ||||||||||||||||||||||||||||||||||||||||||||||||||
1151 HGLAVFQDEGAEPLKQRVEASISKASSFLGEKASAGLLGAHAAAITAYAL 1200

1201 TLTKAPADLRGVAHNNLMAMAQETGDNLYWGSVTGSQSNAVSPTPAPRNP 1250
     ||||||||||||||||||||||||||||||||||||||||||||||||||
1201 TLTKAPADLRGVAHNNLMAMAQETGDNLYWGSVTGSQSNAVSPTPAPRNP 1250

1251 SDPMPQAPALWIETTAYALLHLLLHEGKAEMADQAAAWLTRQGSFQGGFR 1300
     ||||||||||||||||||||||||||||||||||||||||||||||||||
1251 SDPMPQAPALWIETTAYALLHLLLHEGKAEMADQAAAWLTRQGSFQGGFR 1300

1301 STQDTVIALDALSAYWIASHTTEERGLNVTLSSTGRNGFKSHALQLNNRQ 1350
     ||||||||||||||||||||||||||||||||||||||||||||||||||
1301 STQDTVIALDALSAYWIASHTTEERGLNVTLSSTGRNGFKSHALQLNNRQ 1350

1351 IRGLEEELQFSLGSKINVKVGGNSKGTLKVLRTYNVLDMKNTTCQDLQIE 1400
     ||||||||||||||||||||||||||||||||||||||||||||||||||
1351 IRGLEEELQFSLGSKINVKVGGNSKGTLKVLRTYNVLDMKNTTCQDLQIE 1400

1401 VTVKGHVEYTMEANEDYEDYEYDELPAKDDPDAPLQPVTPLQLFEGRRNR 1450
     ||||||||||||||||||||||||||||||||||||||||||||||||||
1401 VTVKGHVEYTMEANEDYEDYEYDELPAKDDPDAPLQPVTPLQLFEGRRNR 1450

1451 RRREAPKVVEEQESRVHYTVCIWWAPGAALGQGREGRTQAGAGLLEPAQA 1500
     |||||||||||||||||||||||||
1451 RRREAPKVVEEQESRVHYTVCIW........................... 1473

1501 EPGRQLTRLHRRNGKVGLSGMAIADVTLLSGFHALRADLEKVWS 1544
                |||||||||||||||||||||||||||||||||:|
1474 ...........RNGKVGLSGMAIADVTLLSGFHALRADLEKLTS 1506
```

Description for Cluster HSSTROL3

Cluster HSSTROL3 features 6 transcript(s) and 16 segment(s) of interest, the names for which are given in Tables 284 and 285, respectively, the sequences themselves are given at the end of the application. The selected protein variants are given in table 286.

TABLE 284

Transcripts of interest

| Transcript Name | Sequence ID No. |
|---|---|
| HSSTROL3_T5 | 34 |
| HSSTROL3_T8 | 35 |
| HSSTROL3_T9 | 36 |
| HSSTROL3_T10 | 37 |
| HSSTROL3_T11 | 38 |
| HSSTROL3_T12 | 39 |

TABLE 285

Segments of interest

| Segment Name | Sequence ID No. |
|---|---|
| HSSTROL3_node_6 | 222 |
| HSSTROL3_node_10 | 223 |
| HSSTROL3_node_13 | 224 |
| HSSTROL3_node_15 | 225 |
| HSSTROL3_node_19 | 226 |
| HSSTROL3_node_21 | 227 |
| HSSTROL3_node_24 | 228 |
| HSSTROL3_node_25 | 229 |
| HSSTROL3_node_26 | 230 |
| HSSTROL3_node_28 | 231 |
| HSSTROL3_node_29 | 232 |
| HSSTROL3_node_11 | 233 |
| HSSTROL3_node_17 | 234 |
| HSSTROL3_node_18 | 235 |

TABLE 285-continued

Segments of interest

| Segment Name | Sequence ID No. |
|---|---|
| HSSTROL3_node_20 | 236 |
| HSSTROL3_node_27 | 237 |

TABLE 286

Proteins of interest

| Protein Name | Sequence ID No. | Corresponding Transcript(s) |
|---|---|---|
| HSSTROL3_P4 | 359 | HSSTROL3_T5 (SEQ ID NO:34) |
| HSSTROL3_P5 | 360 | HSSTROL3_T8 (SEQ ID NO:35) |
|  |  | HSSTROL3_T9 (SEQ ID NO:36) |
| HSSTROL3_P7 | 361 | HSSTROL3_T10 (SEQ ID NO:37) |
| HSSTROL3_P8 | 362 | HSSTROL3_T11 (SEQ ID NO:38) |
| HSSTROL3_P9 | 363 | HSSTROL3_T12 (SEQ ID NO:39) |

These sequences are variants of the known protein Stromelysin-3 precursor (SEQ ID NO:391) (SwissProt accession identifier MM11_HUMAN (SEQ ID NO: 391); known also according to the synonyms EC 3.4.24.-; Matrix metalloproteinase-11; MMP-11; ST3; SL-3), SEQ ID NO: 391) referred to herein as the previously known protein.

Protein Stromelysin-3 precursor (SEQ ID NO:391) is known or believed to have the following function(s): May play an important role in the progression of epithelial malignancies. The sequence for protein Stromelysin-3 precursor (SEQ ID NO:391) is given at the end of the application, as "Stromelysin-3 precursor (SEQ ID NO:391) amino acid sequence".

The following GO Annotation(s) apply to the previously known protein. The following annotation(s) were found: proteolysis and peptidolysis; developmental processes; morphogenesis, which are annotation(s) related to Biological Process; stromelysin 3; calcium binding; zinc binding; hydrolase, which are annotation(s) related to Molecular Function; and extracellular matrix, which are annotation(s) related to Cellular Component.

The GO assignment relies on information from one or more of the SwissProt/TremB1 Protein knowledgebase, available from expasy dot ch/sprot/; or Locuslink, available from ncbi dot nlm dot nih dot gov/projects/LocusLink/.

Cluster HSSTROL3 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 13 refer to weighted expression of ESTs in each category, as "parts per million" (ratio of the expression of ESTs for a particular cluster to the expression of all ESTs in that category, according to parts per million).

Figure 13:
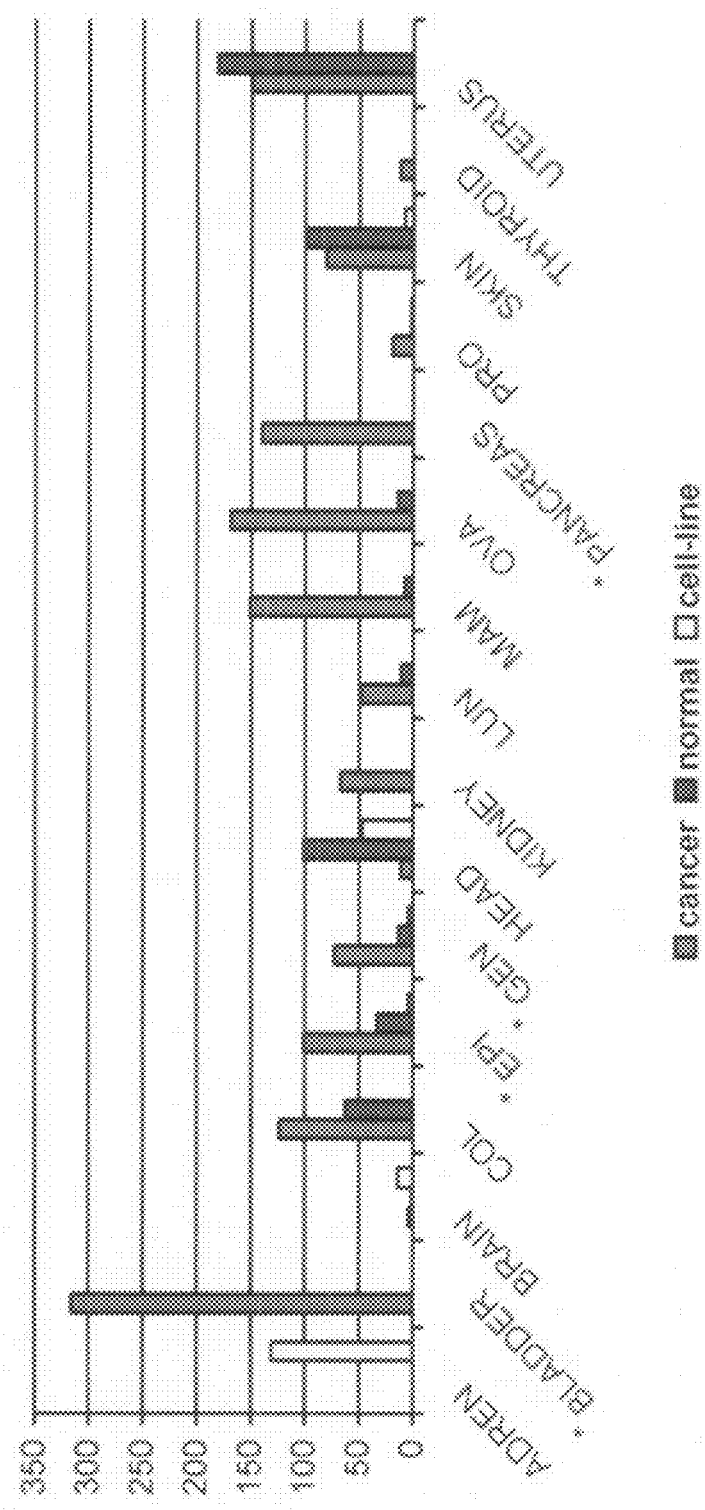
FIG. 13 is a histogram showing Cancer and cell-line vs. normal tissue expression for Cluster HSSTROL3, demonstrating overexpression in transitional cell carcinoma, epithelial malignant tumors, a mixture of malignant tumors from different tissues and pancreas carcinoma.

Overall, the following results were obtained as shown with regard to the histograms in FIG. 13 and Table 287. This cluster is overexpressed (at least at a minimum level) in the following pathological conditions: transitional cell carcinoma, epithelial malignant tumors, a mixture of malignant tumors from different tissues and pancreas carcinoma.

TABLE 287

Normal tissue distribution

| Name of Tissue | Number |
|---|---|
| Adrenal | 0 |
| Bladder | 0 |
| Brain | 1 |
| Colon | 63 |
| Epithelial | 33 |
| General | 13 |
| head and neck | 101 |
| Kidney | 0 |
| Lung | 11 |
| Breast | 8 |
| Ovary | 14 |
| Pancreas | 0 |
| Prostate | 2 |
| Skin | 99 |
| Thyroid | 0 |
| Uterus | 181 |

TABLE 288

P values and ratios for expression in cancerous tissue

| Name of Tissue | P1 | P2 | SP1 | R3 | SP2 | R4 |
|---|---|---|---|---|---|---|
| Adrenal | 1 | 4.6e−01 | 1 | 1.0 | 5.3e−01 | 1.9 |
| Bladder | 2.7e−01 | 3.4e−01 | 3.3e−03 | 4.9 | 2.1e−02 | 3.3 |
| Brain | 3.5e−01 | 2.6e−01 | 1 | 1.7 | 3.3e−01 | 2.8 |
| Colon | 7.7e−02 | 1.5e−02 | 3.1e−01 | 1.4 | 5.2e−01 | 1.0 |
| Epithelial | 1.2e−04 | 1.2e−02 | 1.3e−06 | 2.7 | 4.6e−02 | 1.4 |
| General | 5.4e−09 | 3.1e−05 | 1.8e−16 | 5.0 | 3.1e−07 | 2.6 |
| head and neck | 4.6e−01 | 4.3e−01 | 1 | 0.6 | 9.4e−01 | 0.7 |
| Kidney | 2.5e−01 | 3.5e−01 | 1.1e−01 | 4.0 | 2.4e−01 | 2.8 |
| Lung | 1.8e−01 | 4.5e−01 | 1.9e−01 | 2.7 | 5.1e−01 | 1.4 |
| Breast | 2.0e−01 | 3.4e−01 | 7.3e−02 | 3.3 | 2.5e−01 | 2.0 |
| Ovary | 2.6e−01 | 3.2e−01 | 2.2e−02 | 2.0 | 7.0e−02 | 1.6 |
| Pancreas | 9.5e−02 | 1.8e−01 | 1.8e−04 | 7.8 | 1.6e−03 | 5.5 |
| Prostate | 8.2e−01 | 7.8e−01 | 4.5e−01 | 1.8 | 5.6e−01 | 1.5 |
| Skin | 5.2e−01 | 5.8e−01 | 7.1e−01 | 0.8 | 1 | 0.3 |
| Thyroid | 2.9e−01 | 2.9e−01 | 1 | 1.1 | 1 | 1.1 |
| Uterus | 4.2e−01 | 8.0e−01 | 7.5e−01 | 0.6 | 9.9e−01 | 0.4 |

As noted above, cluster HSSTROL3 features 6 transcript(s), which were listed in Table 284 above. These transcript(s) encode for protein(s) which are variant(s) of protein Stromelysin-3 precursor (SEQ ID NO:391). A description of each variant protein according to the present invention is now provided.

Variant protein HSSTROL3_P4 (SEQ ID NO:359) according to the present invention has an amino acid sequence as given at the end of the application; it is encoded by transcript(s) HSSTROL3_T5 (SEQ ID NO:34). An alignment is given to the known protein (Stromelysin-3 precursor (SEQ ID NO:391)) at the end of the application. One or more alignments to one or more previously published protein sequences are given at the end of the application. A brief description of the relationship of the variant protein according to the present invention to each such aligned protein is as follows:

Comparison report between HSSTROL3_P4 (SEQ ID NO:359) and MM11_HUMAN:

1. An isolated chimeric polypeptide encoding for HSSTROL3_P4 (SEQ ID NO:359) comprising a first amino acid sequence being at least 90% homologous to MAPAAWLRSAAARALLPPMLLLLLQPP-PLLARALPPDVHHLHAERRGPQPWHAALPSS PAPAP-ATQEAPRPASSLRPPRCGVPDPSDGL-SARNRQKRFVLSGGRWEKTDLTYRILRFP WQLVQEQVRQTMAEALKVWSDVTPLT-FTEVHEGRADIMIDFARYW corresponding to amino acids 1-163 of MM11_HUMAN, which also corresponds to amino acids 1-163 of HSSTROL3_P4 (SEQ ID NO:359), a bridging amino acid H corresponding to amino acid 164 of HSSTROL3_P4 (SEQ ID NO:359), a second amino acid sequence being at least 90% homologous to GDDLPFDG-PGGILAHAFFPKTHREGDVHFDYDE-TWTIGDDQGTDLLQVAAHEFGHVLG LQHT-TAAKALMSAFYTFRYPLSLSPDDCRGVQHLYGQPWP TVTSRTPALGPQAGIDTN EIAPLEPDAPPDACEASF-DAVSTIRGELFFFKAGFVWRLRG-GQLQPGYPALASRHWQGL PSPVDAAFEDAQGHIW-FFQGAQYWVYDGEKPVLGPAPLTELGLVRFPVHAA LVWGPE KNKIYFFRGRDYWRFHPSTRRVD-SPVPRRATDWRGVPSEIDAAFQDADG corresponding to amino acids 165-445 of MM11_HUMAN, which also corresponds to amino acids 165-445 of HSSTROL3_P4 (SEQ ID NO:359), and a third amino acid sequence being at least 70%, optionally at least 80%, preferably at least 85%, more preferably at least 90% and most preferably at least 95% homologous to a polypeptide having the sequence ALGVRQLVGGGHSSRFSHLVVAGL-PHACHRKSGSSSQVLCPEPSALLSVAG (SEQ ID NO: 564) corresponding to amino acids 446-496 of HSSTROL3_P4 (SEQ ID NO:359), wherein said first amino acid sequence, bridging amino acid, second amino acid sequence and third amino acid sequence are contiguous and in a sequential order.

2. An isolated polypeptide encoding for a tail of HSSTROL3_P4 (SEQ ID NO:359) comprising a polypeptide being at least 70%, optionally at least about 80%, preferably at least about 85%, more preferably at least about 90% and most preferably at least about 95% homologous to the sequence ALGVRQLVGGGHSSRFSHLVVAGL-PHACHRKSGSSSQVLCPEPSALLSVAG in (SEQ ID NO: 564) HSSTROL3_P4 (SEQ ID NO:359).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P4 (SEQ ID NO:359) also has the following non-silent SNPs (Single Nucleotide Polymorphisms) as listed in Table 289, (given according to their position(s) on the amino acid sequence, with the alternative amino acid(s) listed; the last column indicates whether the SNP is known or not; the presence of known SNPs in variant protein HSSTROL3_P4 (SEQ ID NO:359) sequence provides support for the deduced sequence of this variant protein according to the present invention).

TABLE 289

Amino acid mutations

| SNP position(s) on amino acid sequence | Alternative amino acid(s) | Previously known SNP? |
| --- | --- | --- |
| 38 | V -> A | Yes |
| 104 | R -> P | Yes |

TABLE 289-continued

Amino acid mutations

| SNP position(s) on amino acid sequence | Alternative amino acid(s) | Previously known SNP? |
| --- | --- | --- |
| 214 | A -> | No |
| 323 | Q -> H | Yes |

Variant protein HSSTROL3_P4 (SEQ ID NO:359) is encoded by the following transcript(s): HSSTROL3_T5 (SEQ ID NO:34), for which the sequence(s) is/are given at the end of the application. The coding portion of transcript HSSTROL3_T5 (SEQ ID NO:34) is shown in bold; this coding portion starts at position 24 and ends at position 1511. The transcript also has the following SNPs as listed in Table 290 (given according to their position on the nucleotide sequence, with the alternative nucleic acid listed; the last column indicates whether the SNP is known or not; the presence of known SNPs in variant protein HSSTROL3_P4 (SEQ ID NO:359) sequence provides support for the deduced sequence of this variant protein according to the present invention).

TABLE 290

Nucleic acid SNPs

| SNP position on nucleotide sequence | Alternative nucleic acid | Previously known SNP? |
| --- | --- | --- |
| 136 | T -> C | Yes |
| 334 | G -> C | Yes |
| 663 | G -> | No |
| 699 | -> T | No |
| 992 | G -> C | Yes |
| 1528 | A -> G | Yes |
| 1710 | A -> G | Yes |
| 2251 | A -> G | Yes |
| 2392 | C -> | No |
| 2444 | C -> A | Yes |
| 2470 | A -> T | Yes |
| 2687 | -> G | No |
| 2696 | -> G | No |
| 2710 | C -> | No |
| 2729 | -> A | No |
| 2755 | T -> C | No |
| 2813 | A -> | No |
| 2813 | A -> C | No |
| 2963 | A -> | No |
| 2963 | A -> C | No |
| 2993 | T -> C | Yes |
| 3140 | -> T | No |

Variant protein HSSTROL3_P5 (SEQ ID NO:360) according to the present invention has an amino acid sequence as given at the end of the application; it is encoded by transcript(s) HSSTROL3_T8 (SEQ ID NO:35) and HSSTROL3_T9 (SEQ ID NO:36). An alignment is given to the known protein (Stromelysin-3 precursor (SEQ ID NO:391) at the end of the application. One or more alignments to one or more previously published protein sequences are given at the end of the application. A brief description of the relationship of the variant protein according to the present invention to each such aligned protein is as follows:

Comparison report between HSSTROL3_P5 (SEQ ID NO:360) and MM11_HUMAN:

1. An isolated chimeric polypeptide encoding for HSSTROL3_P5 (SEQ ID NO:360) comprising a first amino acid sequence being at least 90% homologous to MAPAAWLRSAAARALLPPMLLLLLQPPPLLARALPPDVHHLHAERRGPQPWHAALPSS PAPAPATQEAPRPASSLRPPRCGVPDPSDGLSARNRQKRFVLSGGRWEKTDLTYRILRFP WQLVQEQVRQTMAEALKVWSDVTPLTFTEVHEGRADIMIDFARYW corresponding to amino acids 1-163 of MM11_HUMAN, which also corresponds to amino acids 1-163 of HSSTROL3_P5 (SEQ ID NO:360), a bridging amino acid H corresponding to amino acid 164 of HSSTROL3_P5 (SEQ ID NO:360), a second amino acid sequence being at least 90% homologous to GDDLPFDGPGGILAHAFFPKTHREGDVHFDYDETWTIGDDQGTDLLQVAAHEFGHVLG LQHTTAAKALMSAFYTFRYPLSLSPDDCRGVQHLYGQPW PTVTSRTPALGPQAGIDTN EIAPLEPDAPPDACEASFDAVSTIRGELFFFKAGFVWRLRGGQLQPGYPALASRHWQGL PSPVDAAFEDAQGHIWFFQ corresponding to amino acids 165-358 of MM11_HUMAN, which also corresponds to amino acids 165-358 of HSSTROL3_P5 (SEQ ID NO:360), and a third amino acid sequence being at least 70%, optionally at least 80%, preferably at least 85%, more preferably at least 90% and most preferably at least 95% homologous to a polypeptide having the sequence ELGFPSSTGRDESLEHCRCQGLHK (SEQ ID NO: 565) corresponding to amino acids 359-382 of HSSTROL3_P5 (SEQ ID NO:360), wherein said first amino acid sequence, bridging amino acid, second amino acid sequence and third amino acid sequence are contiguous and in a sequential order.

2. An isolated polypeptide encoding for a tail of HSSTROL3_P5 (SEQ ID NO:360) comprising a polypeptide being at least 70%, optionally at least about 80%, preferably at least about 85%, more preferably at least about 90% and most preferably at least about 95% homologous to the sequence ELGFPSSTGRDESLEHCRCQGLHK (SEQ ID NO: 565) in HSSTROL3_P5 (SEQ ID NO:360).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P5 (SEQ ID NO:360) also has the following non-silent SNPs (Single Nucleotide Polymorphisms) as listed in Table 291, (given according to their position(s) on the amino acid sequence, with the alternative amino acid(s) listed; the last column indicates whether the SNP is known or not; the presence of known SNPs in variant protein HSSTROL3_P5 (SEQ ID NO:360) sequence provides support for the deduced sequence of this variant protein according to the present invention).

TABLE 291

Amino acid mutations

| SNP position(s) on amino acid sequence | Alternative amino acid(s) | Previously known SNP? |
| --- | --- | --- |
| 38 | V -> A | Yes |
| 104 | R -> P | Yes |
| 214 | A -> | No |
| 323 | Q -> H | Yes |

Variant protein HSSTROL3_P5 (SEQ ID NO:360) is encoded by the following transcript(s): HSSTROL3_T8 (SEQ ID NO:35) and HSSTROL3_T9 (SEQ ID NO:36), for which the sequence(s) is/are given at the end of the application.

The coding portion of transcript HSSTROL3_T8 (SEQ ID NO:35) is shown in bold; this coding portion starts at position 24 and ends at position 1169. The transcript also has the following SNPs as listed in Table 292 (given according to their position on the nucleotide sequence, with the alternative nucleic acid listed; the last column indicates whether the SNP is known or not; the presence of known SNPs in variant protein HSSTROL3_P5 (SEQ ID NO:360) sequence provides support for the deduced sequence of this variant protein according to the present invention).

TABLE 292

Nucleic acid SNPs

| SNP position on nucleotide sequence | Alternative nucleic acid | Previously known SNP? |
| --- | --- | --- |
| 136 | T -> C | Yes |
| 334 | G -> C | Yes |
| 663 | G -> | No |
| 699 | -> T | No |
| 992 | G -> C | Yes |
| 1903 | C -> | No |
| 1955 | C -> A | Yes |
| 1981 | A -> T | Yes |
| 2198 | -> G | No |
| 2207 | -> G | No |
| 2221 | C -> | No |
| 2240 | -> A | No |
| 2266 | T -> C | No |
| 2324 | A -> | No |
| 2324 | A -> C | No |
| 2474 | A -> | No |
| 2474 | A -> C | No |
| 2504 | T -> C | Yes |
| 2651 | -> T | No |

The coding portion of transcript HSSTROL3_T9 (SEQ ID NO:36) is shown in bold; this coding portion starts at position 24 and ends at position 1169. The transcript also has the following SNPs as listed in Table 293 (given according to their position on the nucleotide sequence, with the alternative nucleic acid listed; the last column indicates whether the SNP is known or not; the presence of known SNPs in variant protein HSSTROL3_P5 (SEQ ID NO:360) sequence provides support for the deduced sequence of this variant protein according to the present invention).

TABLE 293

Nucleic acid SNPs

| SNP position on nucleotide sequence | Alternative nucleic acid | Previously known SNP? |
| --- | --- | --- |
| 136 | T -> C | Yes |
| 334 | G -> C | Yes |
| 663 | G -> | No |
| 699 | -> T | No |
| 992 | G -> C | Yes |
| 1666 | A -> G | Yes |
| 1848 | A -> G | Yes |
| 2389 | A -> G | Yes |
| 2530 | C -> | No |
| 2582 | C -> A | Yes |
| 2608 | A -> T | Yes |
| 2825 | -> G | No |
| 2834 | -> G | No |

TABLE 293-continued

Nucleic acid SNPs

| SNP position on nucleotide sequence | Alternative nucleic acid | Previously known SNP? |
|---|---|---|
| 2848 | C -> | No |
| 2867 | -> A | No |
| 2893 | T -> C | No |
| 2951 | A -> | No |
| 2951 | A -> C | No |
| 3101 | A -> | No |
| 3101 | A -> C | No |
| 3131 | T -> C | Yes |
| 3278 | -> T | No |

Variant protein HSSTROL3_P7 (SEQ ID NO:361) according to the present invention has an amino acid sequence as given at the end of the application; it is encoded by transcript(s) HSSTROL3_T10 (SEQ ID NO:37). An alignment is given to the known protein (Stromelysin-3 precursor (SEQ ID NO:391)) at the end of the application. One or more alignments to one or more previously published protein sequences are given at the end of the application. A brief description of the relationship of the variant protein according to the present invention to each such aligned protein is as follows:

Comparison report between HSSTROL3_P7 (SEQ ID NO:361) and MM11_HUMAN:

1. An isolated chimeric polypeptide encoding for HSSTROL3_P7 (SEQ ID NO:361) comprising a first amino acid sequence being at least 90% homologous to MAPAAWLRSAAARALLPPMLLLLLQPP-PLLARALPPDVHHLHAERRGPQPWHAALPSS PAPAP-ATQEAPRPASSLRPPRCGVPDPSDGL-SARNRQKRFVLSGGRWEKTDLTYRILRFP WQLVQEQVRQTMAEALKVWSDVTPLT-FTEVHEGRADIMIDFARYW corresponding to amino acids 1-163 of MM11_HUMAN, which also corresponds to amino acids 1-163 of HSSTROL3_P7 (SEQ ID NO:361), a bridging amino acid H corresponding to amino acid 164 of HSSTROL3_P7 (SEQ ID NO:361), a second amino acid sequence being at least 90% homologous to GDDLPFDG-PGGILAHAFFPKTHREGDVHFDYDE-TWTIGDDQGTDLLQVAAHEFGHVLG LQHT-TAAKALMSAFYTFRYPLSLSPDDCRGVQHLYGQPWP TVTSRTPALGPQAGIDTN EIAPLEPDAPPDACEASF-DAVSTIRGELFFFKAGFVWRLRG-GQLQPGYPALASRHWQGL PSPVDAAFEDAQGHIW-FFQG corresponding to amino acids 165-359 of MM11_HUMAN, which also corresponds to amino acids 165-359 of HSSTROL3_P7 (SEQ ID NO:361), and a third amino acid sequence being at least 70%, optionally at least 80%, preferably at least 85%, more preferably at least 90% and most preferably at least 95% homologous to a polypeptide having the sequence TTGVSTPAPGV (SEQ ID NO: 566) corresponding to amino acids 360-370 of HSSTROL3_P7 (SEQ ID NO:361), wherein said first amino acid sequence, bridging amino acid, second amino acid sequence and third amino acid sequence are contiguous and in a sequential order.

2. An isolated polypeptide encoding for a tail of HSSTROL3_P7 (SEQ ID NO:361) comprising a polypeptide being at least 70%, optionally at least about 80%, preferably at least about 85%, more preferably at least about 90% and most preferably at least about 95% homologous to the sequence TTGVSTPAPGV (SEQ ID NO: 566) in HSSTROL3_P7 (SEQ ID NO:361).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P7 (SEQ ID NO:361) also has the following non-silent SNPs (Single Nucleotide Polymorphisms) as listed in Table 294, (given according to their position(s) on the amino acid sequence, with the alternative amino acid(s) listed; the last column indicates whether the SNP is known or not; the presence of known SNPs in variant protein HSSTROL3_P7 (SEQ ID NO:361) sequence provides support for the deduced sequence of this variant protein according to the present invention).

TABLE 294

Amino acid mutations

| SNP position(s) on amino acid sequence | Alternative amino acid(s) | Previously known SNP? |
|---|---|---|
| 38 | V -> A | Yes |
| 104 | R -> P | Yes |
| 214 | A -> | No |
| 323 | Q -> H | Yes |

Variant protein HSSTROL3_P7 (SEQ ID NO:361) is encoded by the following transcript(s): HSSTROL3_T10 (SEQ ID NO:37), for which the sequence(s) is/are given at the end of the application. The coding portion of transcript HSSTROL3_T10 (SEQ ID NO:37) is shown in bold; this coding portion starts at position 24 and ends at position 1133. The transcript also has the following SNPs as listed in Table 295 (given according to their position on the nucleotide sequence, with the alternative nucleic acid listed; the last column indicates whether the SNP is known or not; the presence of known SNPs in variant protein HSSTROL3_P7 (SEQ ID NO:361) sequence provides support for the deduced sequence of this variant protein according to the present invention).

TABLE 295

Nucleic acid SNPs

| SNP position on nucleotide sequence | Alternative nucleic acid | Previously known SNP? |
|---|---|---|
| 136 | T -> C | Yes |
| 334 | G -> C | Yes |
| 663 | G -> | No |
| 699 | -> T | No |
| 992 | G -> C | Yes |
| 1386 | A -> G | Yes |
| 1568 | A -> G | Yes |
| 2109 | A -> G | Yes |
| 2250 | C -> | No |
| 2302 | C -> A | Yes |
| 2328 | A -> T | Yes |
| 2545 | -> G | No |
| 2554 | -> G | No |
| 2568 | C -> | No |
| 2587 | -> A | No |
| 2613 | T -> C | No |
| 2671 | A -> | No |
| 2671 | A -> C | No |

TABLE 295-continued

Nucleic acid SNPs

| SNP position on nucleotide sequence | Alternative nucleic acid | Previously known SNP? |
|---|---|---|
| 2821 | A -> | No |
| 2821 | A -> C | No |
| 2851 | T -> C | Yes |
| 2998 | -> T | No |

Variant protein HSSTROL3_P8 (SEQ ID NO:362) according to the present invention has an amino acid sequence as given at the end of the application; it is encoded by transcript(s) HSSTROL3_T11 (SEQ ID NO:38). An alignment is given to the known protein (Stromelysin-3 precursor (SEQ ID NO:391)) at the end of the application. One or more alignments to one or more previously published protein sequences are given at the end of the application. A brief description of the relationship of the variant protein according to the present invention to each such aligned protein is as follows:

Comparison report between HSSTROL3_P8 (SEQ ID NO:362) and MM11_HUMAN:

1. An isolated chimeric polypeptide encoding for HSSTROL3_P8 (SEQ ID NO:362) comprising a first amino acid sequence being at least 90% homologous to MAPAAWLRSAAARALLPPMLLLLLQPP-PLLARALPPDVHHLHAERRGPQPWHAALPSS PAPAP-ATQEAPRPAS SLRPPRCGVPDPSDGLSARNRQKRFV-LSGGRWEKTDLTYRILRFP WQLVQEQVRQTMAEALKVWSDVTPLT-FTEVHEGRADIMIDFARYW corresponding to amino acids 1-163 of MM11_HUMAN, which also corresponds to amino acids 1-163 of HSSTROL3_P8 (SEQ ID NO:362), a bridging amino acid H corresponding to amino acid 164 of HSSTROL3_P8 (SEQ ID NO:362), a second amino acid sequence being at least 90% homologous to GDDLPFDG-PGGILAHAFFPKTHREGDVHFDYDE-TWTIGDDQGTDLLQVAAHEFGHVLG LQHT-TAAKALMSAFYTFRYPLSLSPDDCRGVQHLYGQPW PTVTSRTPALGPQAGIDTN EIAPLE corresponding to amino acids 165-286 of MM11_HUMAN, which also corresponds to amino acids 165-286 of HSSTROL3_P8 (SEQ ID NO:362), and a third amino acid sequence being at least 70%, optionally at least 80%, preferably at least 85%, more preferably at least 90% and most preferably at least 95% homologous to a polypeptide having the sequence VRP-CLPVPLLLCWPL (SEQ ID NO: 567) corresponding to amino acids 287-301 of HSSTROL3_P8 (SEQ ID NO:362), wherein said first amino acid sequence, bridging amino acid, second amino acid sequence and third amino acid sequence are contiguous and in a sequential order.

2. An isolated polypeptide encoding for a tail of HSSTROL3_P8 (SEQ ID NO:362) comprising a polypeptide being at least 70%, optionally at least about 80%, preferably at least about 85%, more preferably at least about 90% and most preferably at least about 95% homologous to the sequence VRPCLPVPLLLCWPL (SEQ ID NO: 567) in HSSTROL3_P8 (SEQ ID NO:362).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P8 (SEQ ID NO:362) also has the following non-silent SNPs (Single Nucleotide Polymorphisms) as listed in Table 296, (given according to their position(s) on the amino acid sequence, with the alternative amino acid(s) listed; the last column indicates whether the SNP is known or not; the presence of known SNPs in variant protein HSSTROL3_P8 (SEQ ID NO:362) sequence provides support for the deduced sequence of this variant protein according to the present invention).

TABLE 296

Amino acid mutations

| SNP position(s) on amino acid sequence | Alternative amino acid(s) | Previously known SNP? |
|---|---|---|
| 38 | V -> A | Yes |
| 104 | R -> P | Yes |
| 214 | A -> | No |

Variant protein HSSTROL3_P8 (SEQ ID NO:362) is encoded by the following transcript(s): HSSTROL3_T11 (SEQ ID NO:38), for which the sequence(s) is/are given at the end of the application. The coding portion of transcript HSSTROL3_T11 (SEQ ID NO:38) is shown in bold; this coding portion starts at position 24 and ends at position 926. The transcript also has the following SNPs as listed in Table 297 (given according to their position on the nucleotide sequence, with the alternative nucleic acid listed; the last column indicates whether the SNP is known or not; the presence of known SNPs in variant protein HSSTROL3_P8 (SEQ ID NO:362) sequence provides support for the deduced sequence of this variant protein according to the present invention).

TABLE 297

Nucleic acid SNPs

| SNP position on nucleotide sequence | Alternative nucleic acid | Previously known SNP? |
|---|---|---|
| 136 | T -> C | Yes |
| 334 | G -> C | Yes |
| 663 | G -> | No |
| 699 | -> T | No |
| 935 | G -> A | Yes |
| 948 | G -> A | Yes |
| 1084 | G -> C | Yes |
| 1557 | C -> | No |
| 1609 | C -> A | Yes |
| 1635 | A -> T | Yes |
| 1852 | -> G | No |
| 1861 | -> G | No |
| 1875 | C -> | No |
| 1894 | -> A | No |
| 1920 | T -> C | No |
| 1978 | A -> | No |
| 1978 | A -> C | No |
| 2128 | A -> | No |
| 2128 | A -> C | No |
| 2158 | T -> C | Yes |
| 2305 | -> T | No |

Variant protein HSSTROL3_P9 (SEQ ID NO:363) according to the present invention has an amino acid sequence as given at the end of the application; it is encoded by transcript(s) HSSTROL3_T12 (SEQ ID NO:39). An alignment is given to the known protein (Stromelysin-3 precursor (SEQ ID NO:391) at the end of the application. One or more alignments to one or more previously published protein sequences are given at the end of the application. A brief description of the relationship of the variant protein according to the present invention to each such aligned protein is as follows:

Comparison report between HSSTROL3_P9 (SEQ ID NO:363) and MM11_HUMAN:

1. An isolated chimeric polypeptide encoding for HSSTROL3_P9 (SEQ ID NO:363) comprising a first amino acid sequence being at least 90% homologous to MAPAAWLRSAAARALLPPMLLLLLQPP-PLLARALPPDVHHLHAERRGPQPWHAALPSS PAPAP-ATQEAPRPASSLRPPRCGVPDPSDGLSARNRQK corresponding to amino acids 1-96 of MM11_HUMAN, which also corresponds to amino acids 1-96 of HSSTROL3_P9 (SEQ ID NO:363), a second amino acid sequence being at least 90% homologous to RILRFPWQLVQEQVRQTMAE-ALKVWSDVTPLTFTEVHEGRADIMIDFARYW corresponding to amino acids 113-163 of MM11_HUMAN, which also corresponds to amino acids 97-147 of HSSTROL3_P9 (SEQ ID NO:363), a bridging amino acid H corresponding to amino acid 148 of HSSTROL3_P9 (SEQ ID NO:363), a third amino acid sequence being at least 90% homologous to GDDLPFDGPGGILAHAFFPKTHREGD-VHFDYDETWTIGDDQGTDLLQVAAHEFGHVLG LQHTTAAKALMSAFYTFRYPLSLSPD-DCRGVQHLYGQPWPTVTSRTPALGPQAGIDTN EIA-PLEPDAPPDACEASFDAVSTIRGEL-FFFKAGFVWRLRGGQLQPGYPALASRHWQGL PSPVDAAFEDAQGHIWFFQG corresponding to amino acids 165-359 of MM11_HUMAN, which also corresponds to amino acids 149-343 of HSSTROL3_P9 (SEQ ID NO:363), and a fourth amino acid sequence being at least 70%, optionally at least 80%, preferably at least 85%, more preferably at least 90% and most preferably at least 95% homologous to a polypeptide having the sequence TTGVST-PAPGV (SEQ ID NO: 566) corresponding to amino acids 344-354 of HSSTROL3_P9 (SEQ ID NO:363), wherein said first amino acid sequence, second amino acid sequence, bridging amino acid, third amino acid sequence and fourth amino acid sequence are contiguous and in a sequential order.

2. An isolated chimeric polypeptide encoding for an edge portion of HSSTROL3_P9 (SEQ ID NO:363), comprising a polypeptide having a length "n", wherein n is at least about 10 amino acids in length, optionally at least about 20 amino acids in length, preferably at least about 30 amino acids in length, more preferably at least about 40 amino acids in length and most preferably at least about 50 amino acids in length, wherein at least two amino acids comprise KR, having a structure as follows: a sequence starting from any of amino acid numbers 96-x to 96; and ending at any of amino acid numbers 97+((n−2)−x), in which x varies from 0 to n−2.

3. An isolated polypeptide encoding for a tail of HSSTROL3_P9 (SEQ ID NO:363), comprising a polypeptide being at least 70%, optionally at least about 80%, preferably at least about 85%, more preferably at least about 90% and most preferably at least about 95% homologous to the sequence TTGVSTPAPGV (SEQ ID NO: 566) in HSSTROL3_P9 (SEQ ID NO:363).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSSTROL3_P9 (SEQ ID NO:363) also has the following non-silent SNPs (Single Nucleotide Polymorphisms) as listed in Table 298, (given according to their position(s) on the amino acid sequence, with the alternative amino acid(s) listed; the last column indicates whether the SNP is known or not; the presence of known SNPs in variant protein HSSTROL3_P9 (SEQ ID NO:363) sequence provides support for the deduced sequence of this variant protein according to the present invention).

TABLE 298

Amino acid mutations

| SNP position(s) on amino acid sequence | Alternative amino acid(s) | Previously known SNP? |
|---|---|---|
| 38 | V -> A | Yes |
| 198 | A -> | No |
| 307 | Q -> H | Yes |

Variant protein HSSTROL3_P9 (SEQ ID NO:363) is encoded by the following transcript(s): HSSTROL3_T12 (SEQ ID NO:39), for which the sequence(s) is/are given at the end of the application. The coding portion of transcript HSSTROL3_T12 (SEQ ID NO:39) is shown in bold; this coding portion starts at position 24 and ends at position 1085. The transcript also has the following SNPs as listed in Table 299 (given according to their position on the nucleotide sequence, with the alternative nucleic acid listed; the last column indicates whether the SNP is known or not; the presence of known SNPs in variant protein HSSTROL3_P9 (SEQ ID NO:363) sequence provides support for the deduced sequence of this variant protein according to the present invention).

TABLE 299

Nucleic acid SNPs

| SNP position on nucleotide sequence | Alternative nucleic acid | Previously known SNP? |
|---|---|---|
| 136 | T -> C | Yes |
| 615 | G -> | No |
| 651 | -> T | No |
| 944 | G -> C | Yes |
| 1275 | C -> | No |
| 1327 | C -> A | Yes |
| 1353 | A -> T | Yes |
| 1570 | -> G | No |
| 1579 | -> G | No |
| 1593 | C -> | No |
| 1612 | -> A | No |
| 1638 | T -> C | No |
| 1696 | A -> | No |
| 1696 | A -> C | No |
| 1846 | A -> | No |
| 1846 | A -> C | No |
| 1876 | T -> C | Yes |
| 2023 | -> T | No |

As noted above, cluster HSSTROL3 features 16 segment(s), which were listed in Table 2 above and for which the sequence(s) are given at the end of the application. These segment(s) are portions of nucleic acid sequence(s)

which are described herein separately because they are of particular interest. A description of each segment according to the present invention is now provided.

Segment cluster HSSTROL3_node_6 (SEQ ID NO:222) according to the present invention is supported by 14 libraries. The number of libraries was determined as previously described. This segment can be found in the following transcript(s): HSSTROL3_T5 (SEQ ID NO:34), HSSTROL3_T8 (SEQ ID NO:35), HSSTROL3_T9 (SEQ ID NO:36), HSSTROL3_T10 (SEQ ID NO:37), HSSTROL3_T11 (SEQ ID NO:38) and HSSTROL3_T12 (SEQ ID NO:39). Table 300 below describes the starting and ending position of this segment on each transcript.

TABLE 300

Segment location on transcripts

| Transcript name | Segment starting position | Segment ending position |
|---|---|---|
| HSSTROL3_T5 (SEQ ID NO:34) | 1 | 131 |
| HSSTROL3_T8 (SEQ ID NO:35) | 1 | 131 |
| HSSTROL3_T9 (SEQ ID NO:36) | 1 | 131 |
| HSSTROL3_T10 (SEQ ID NO:37) | 1 | 131 |
| HSSTROL3_T11 (SEQ ID NO:38) | 1 | 131 |
| HSSTROL3_T12 (SEQ ID NO:39) | 1 | 131 |

Segment cluster HSSTROL3_node_10 (SEQ ID NO:223) according to the present invention is supported by 21 libraries. The number of libraries was determined as previously described. This segment can be found in the following transcript(s): HSSTROL3_T5 (SEQ ID NO:34), HSSTROL3_T8 (SEQ ID NO:35), HSSTROL3_T9 (SEQ ID NO:36), HSSTROL3_T10 (SEQ ID NO:37), HSSTROL3_T11 (SEQ ID NO:38) and HSSTROL3_T12 (SEQ ID NO:39). Table 301 below describes the starting and ending position of this segment on each transcript.

TABLE 301

Segment location on transcripts

| Transcript name | Segment starting position | Segment ending position |
|---|---|---|
| HSSTROL3_T5 (SEQ ID NO:34) | 132 | 313 |
| HSSTROL3_T8 (SEQ ID NO:35) | 132 | 313 |
| HSSTROL3_T9 (SEQ ID NO:36) | 132 | 313 |
| HSSTROL3_T10 (SEQ ID NO:37) | 132 | 313 |
| HSSTROL3_T11 (SEQ ID NO:38) | 132 | 313 |
| HSSTROL3_T12 (SEQ ID NO:39) | 132 | 313 |

Segment cluster HSSTROL3_node_13 (SEQ ID NO:224) according to the present invention is supported by 36 libraries. The number of libraries was determined as previously described. This segment can be found in the following transcript(s): HSSTROL3_T5 (SEQ ID NO:34), HSSTROL3_T8 (SEQ ID NO:35), HSSTROL3_T9 (SEQ ID NO:36), HSSTROL3_T10 (SEQ ID NO:37), HSSTROL3_T11 (SEQ ID NO:38) and HSSTROL3_T12 (SEQ ID NO:39). Table 302 below describes the starting and ending position of this segment on each transcript.

TABLE 302

Segment location on transcripts

| Transcript name | Segment starting position | Segment ending position |
|---|---|---|
| HSSTROL3_T5 (SEQ ID NO:34) | 362 | 505 |
| HSSTROL3_T8 (SEQ ID NO:35) | 362 | 505 |
| HSSTROL3_T9 (SEQ ID NO:36) | 362 | 505 |
| HSSTROL3_T10 (SEQ ID NO:37) | 362 | 505 |
| HSSTROL3_T11 (SEQ ID NO:38) | 362 | 505 |
| HSSTROL3_T12 (SEQ ID NO:39) | 314 | 457 |

Segment cluster HSSTROL3_node_15 (SEQ ID NO:225) according to the present invention is supported by 47 libraries. The number of libraries was determined as previously described. This segment can be found in the following transcript(s): HSSTROL3_T5 (SEQ ID NO:34), HSSTROL3_T8 (SEQ ID NO:35), HSSTROL3_T9 (SEQ ID NO:36), HSSTROL3_T10 (SEQ ID NO:37), HSSTROL3_T11 (SEQ ID NO:38) and HSSTROL3_T12 (SEQ ID NO:39). Table 303 below describes the starting and ending position of this segment on each transcript.

TABLE 303

Segment location on transcripts

| Transcript name | Segment starting position | Segment ending position |
|---|---|---|
| HSSTROL3_T5 (SEQ ID NO:34) | 506 | 639 |
| HSSTROL3_T8 (SEQ ID NO:35) | 506 | 639 |
| HSSTROL3_T9 (SEQ ID NO:36) | 506 | 639 |
| HSSTROL3_T10 (SEQ ID NO:37) | 506 | 639 |
| HSSTROL3_T11 (SEQ ID NO:38) | 506 | 639 |
| HSSTROL3_T12 (SEQ ID NO:39) | 458 | 591 |

Segment cluster HSSTROL3_node_19 (SEQ ID NO:226) according to the present invention is supported by 63 libraries. The number of libraries was determined as previously described. This segment can be found in the following transcript(s): HSSTROL3_T5 (SEQ ID NO:34), HSSTROL3_T8 (SEQ ID NO:35), HSSTROL3_T9 (SEQ ID NO:36), HSSTROL3_T10 (SEQ ID NO:37), HSSTROL3_T11 (SEQ ID NO:38) and HSSTROL3_T12 (SEQ ID NO:39). Table 304 below describes the starting and ending position of this segment on each transcript.

TABLE 304

Segment location on transcripts

| Transcript name | Segment starting position | Segment ending position |
|---|---|---|
| HSSTROL3_T5 (SEQ ID NO:34) | 699 | 881 |
| HSSTROL3_T8 (SEQ ID NO:35) | 699 | 881 |
| HSSTROL3_T9 (SEQ ID NO:36) | 699 | 881 |
| HSSTROL3_T10 (SEQ ID NO:37) | 699 | 881 |
| HSSTROL3_T11 (SEQ ID NO:38) | 699 | 881 |
| HSSTROL3_T12 (SEQ ID NO:39) | 651 | 833 |

Segment cluster HSSTROL3_node_21 (SEQ ID NO:227) according to the present invention is supported by 61 libraries. The number of libraries was determined as previously described. This segment can be found in the following transcript(s): HSSTROL3_T5 (SEQ ID NO:34), HSSTROL3_T8 (SEQ ID NO:35), HSSTROL3_T9 (SEQ ID NO:36), HSSTROL3_T10 (SEQ ID NO:37), HSSTROL3_T11 (SEQ ID NO:38) and HSSTROL3_T12

(SEQ ID NO:39). Table 305 below describes the starting and ending position of this segment on each transcript.

TABLE 305

Segment location on transcripts

| Transcript name | Segment starting position | Segment ending position |
|---|---|---|
| HSSTROL3_T5 (SEQ ID NO:34) | 882 | 1098 |
| HSSTROL3_T8 (SEQ ID NO:35) | 882 | 1098 |
| HSSTROL3_T9 (SEQ ID NO:36) | 882 | 1098 |
| HSSTROL3_T10 (SEQ ID NO:37) | 882 | 1098 |
| HSSTROL3_T11 (SEQ ID NO:38) | 974 | 1190 |
| HSSTROL3_T12 (SEQ ID NO:39) | 834 | 1050 |

Segment cluster HSSTROL3_node_24 (SEQ ID NO:228) according to the present invention is supported by 7 libraries. The number of libraries was determined as previously described. This segment can be found in the following transcript(s): HSSTROL3_T8 (SEQ ID NO:35) and HSSTROL3_T9 (SEQ ID NO:36). Table 306 below describes the starting and ending position of this segment on each transcript.

TABLE 306

Segment location on transcripts

| Transcript name | Segment starting position | Segment ending position |
|---|---|---|
| HSSTROL3_T8 (SEQ ID NO:35) | 1099 | 1236 |
| HSSTROL3_T9 (SEQ ID NO:36) | 1099 | 1236 |

Segment cluster HSSTROL3_node_25 (SEQ ID NO:229) according to the present invention is supported by 13 libraries. The number of libraries was determined as previously described. This segment can be found in the following transcript(s): HSSTROL3_T8 (SEQ ID NO:35). Table 307 below describes the starting and ending position of this segment on each transcript.

TABLE 307

Segment location on transcripts

| Transcript name | Segment starting position | Segment ending position |
|---|---|---|
| HSSTROL3_T8 (SEQ ID NO:35) | 1237 | 1536 |

Segment cluster HSSTROL3_node_26 (SEQ ID NO:230) according to the present invention is supported by 55 libraries. The number of libraries was determined as previously described. This segment can be found in the following transcript(s): HSSTROL3_T5 (SEQ ID NO:34), HSSTROL3_T8 (SEQ ID NO:35), HSSTROL3_T9 (SEQ ID NO:36) and HSSTROL3_T 11 (SEQ ID NO:38). Table 308 below describes the starting and ending position of this segment on each transcript.

TABLE 308

Segment location on transcripts

| Transcript name | Segment starting position | Segment ending position |
|---|---|---|
| HSSTROL3_T5 (SEQ ID NO:34) | 1099 | 1240 |
| HSSTROL3_T8 (SEQ ID NO:35) | 1537 | 1678 |

TABLE 308-continued

Segment location on transcripts

| Transcript name | Segment starting position | Segment ending position |
|---|---|---|
| HSSTROL3_T9 (SEQ ID NO:36) | 1237 | 1378 |
| HSSTROL3_T11 (SEQ ID NO:38) | 1191 | 1332 |

Segment cluster HSSTROL3_node_28 (SEQ ID NO:231) according to the present invention is supported by 10 libraries. The number of libraries was determined as previously described. This segment can be found in the following transcript(s): HSSTROL3_T5 (SEQ ID NO:34), HSSTROL3_T9 (SEQ ID NO:36) and HSSTROL3_T10 (SEQ ID NO:37). Table 309 below describes the starting and ending position of this segment on each transcript.

TABLE 309

Segment location on transcripts

| Transcript name | Segment starting position | Segment ending position |
|---|---|---|
| HSSTROL3_T5 (SEQ ID NO:34) | 1357 | 2283 |
| HSSTROL3_T9 (SEQ ID NO:36) | 1495 | 2421 |
| HSSTROL3_T10 (SEQ ID NO:37) | 1215 | 2141 |

Segment cluster HSSTROL3_node_29 (SEQ ID NO:232) according to the present invention is supported by 109 libraries. The number of libraries was determined as previously described. This segment can be found in the following transcript(s): HSSTROL3_T5 (SEQ ID NO:34), HSSTROL3_T8 (SEQ ID NO:35), HSSTROL3_T9 (SEQ ID NO:36), HSSTROL3_T10 (SEQ ID NO:37), HSSTROL3_T11 (SEQ ID NO:38) and HSSTROL3_T12 (SEQ ID NO:39). Table 310 below describes the starting and ending position of this segment on each transcript.

TABLE 310

Segment location on transcripts

| Transcript name | Segment starting position | Segment ending position |
|---|---|---|
| HSSTROL3_T5 (SEQ ID NO:34) | 2284 | 3194 |
| HSSTROL3_T8 (SEQ ID NO:35) | 1795 | 2705 |
| HSSTROL3_T9 (SEQ ID NO:36) | 2422 | 3332 |
| HSSTROL3_T10 (SEQ ID NO:37) | 2142 | 3052 |
| HSSTROL3_T11 (SEQ ID NO:38) | 1449 | 2359 |
| HSSTROL3_T12 (SEQ ID NO:39) | 1167 | 2077 |

According to an optional embodiment of the present invention, short segments related to the above cluster are also provided. These segments are up to about 120 bp in length, and so are included in a separate description.

Segment cluster HSSTROL3_node_11 (SEQ ID NO:233) according to the present invention is supported by 25 libraries. The number of libraries was determined as previously described. This segment can be found in the following transcript(s): HSSTROL3_T5 (SEQ ID NO:34), HSSTROL3_T8 (SEQ ID NO:35), HSSTROL3_T9 (SEQ ID NO:36) HSSTROL3_T10 (SEQ ID NO:37) and HSSTROL3_T11 (SEQ ID NO:38). Table 311 below describes the starting and ending position of this segment on each transcript.

TABLE 311

Segment location on transcripts

| Transcript name | Segment starting position | Segment ending position |
|---|---|---|
| HSSTROL3_T5 (SEQ ID NO:34) | 314 | 361 |
| HSSTROL3_T8 (SEQ ID NO:35) | 314 | 361 |
| HSSTROL3_T9 (SEQ ID NO:36) | 314 | 361 |
| HSSTROL3_T10 (SEQ ID NO:37) | 314 | 361 |
| HSSTROL3_T11 (SEQ ID NO:38) | 314 | 361 |

Segment cluster HSSTROL3_node_17 (SEQ ID NO:234) according to the present invention is supported by 45 libraries. The number of libraries was determined as previously described. This segment can be found in the following transcript(s): HSSTROL3_T5 (SEQ ID NO:34), HSSTROL3_T8 (SEQ ID NO:35), HSSTROL3_T9 (SEQ ID NO:36), HSSTROL3_T10 (SEQ ID NO:37), HSSTROL3_T 11 (SEQ ID NO:38) and HSSTROL3_T12 (SEQ ID NO:39). Table 312 below describes the starting and ending position of this segment on each transcript.

TABLE 312

Segment location on transcripts

| Transcript name | Segment starting position | Segment ending position |
|---|---|---|
| HSSTROL3_T5 (SEQ ID NO:34) | 640 | 680 |
| HSSTROL3_T8 (SEQ ID NO:35) | 640 | 680 |
| HSSTROL3_T9 (SEQ ID NO:36) | 640 | 680 |
| HSSTROL3_T10 (SEQ ID NO:37) | 640 | 680 |
| HSSTROL3_T11 (SEQ ID NO:38) | 640 | 680 |
| HSSTROL3_T12 (SEQ ID NO:39) | 592 | 632 |

Segment cluster HSSTROL3_node_18 (SEQ ID NO:235) according to the present invention can be found in the following transcript(s): HSSTROL3_T5 (SEQ ID NO:34) HSSTROL3_T8 (SEQ ID NO:35), HSSTROL3_T9 (SEQ ID NO:36), HSSTROL3_T10 (SEQ ID NO:37), HSSTROL3_T11 (SEQ ID NO:38) and HSSTROL3_T12 (SEQ ID NO:39). Table 313 below describes the starting and ending position of this segment on each transcript.

TABLE 313

Segment location on transcripts

| Transcript name | Segment starting position | Segment ending position |
|---|---|---|
| HSSTROL3_T5 (SEQ ID NO:34) | 681 | 698 |
| HSSTROL3_T8 (SEQ ID NO:35) | 681 | 698 |
| HSSTROL3_T9 (SEQ ID NO:36) | 681 | 698 |
| HSSTROL3_T10 (SEQ ID NO:37) | 681 | 698 |
| HSSTROL3_T11 (SEQ ID NO:38) | 681 | 698 |
| HSSTROL3_T12 (SEQ ID NO:39) | 633 | 650 |

Segment cluster HSSTROL3_node_20 (SEQ ID NO:236) according to the present invention is supported by 1 libraries. The number of libraries was determined as previously described. This segment can be found in the following transcript(s): HSSTROL3_T11 (SEQ ID NO:38). Table 314 below describes the starting and ending position of this segment on each transcript.

TABLE 314

Segment location on transcripts

| Transcript name | Segment starting position | Segment ending position |
|---|---|---|
| HSSTROL3_T11 (SEQ ID NO:38) | 882 | 973 |

Segment cluster HSSTROL3_node_27 (SEQ ID NO:237) according to the present invention is supported by 50 libraries. The number of libraries was determined as previously described. This segment can be found in the following transcript(s): HSSTROL3_T5 (SEQ ID NO:34), HSSTROL3_T8 (SEQ ID NO:35), HSSTROL3_T9 (SEQ ID NO:36), HSSTROL3_T10 (SEQ ID NO:37), HSSTROL3_T11 (SEQ ID NO:38) and HSSTROL3 T12 (SEQ ID NO:39). Table 315 below describes the starting and ending position of this segment on each transcript.

TABLE 315

Segment location on transcripts

| Transcript name | Segment starting position | Segment ending position |
|---|---|---|
| HSSTROL3_T5 (SEQ ID NO:34) | 1241 | 1356 |
| HSSTROL3_T8 (SEQ ID NO:35) | 1679 | 1794 |
| HSSTROL3_T9 (SEQ ID NO:36) | 1379 | 1494 |
| HSSTROL3_T10 (SEQ ID NO:37) | 1099 | 1214 |
| HSSTROL3_T11 (SEQ ID NO:38) | 1333 | 1448 |
| HSSTROL3_T12 (SEQ ID NO:39) | 1051 | 1166 |

Variant Protein Alignment to the Previously Known Protein:

```
Sequence name: MM11_HUMAN
Sequence documentation:
Alignment of: HSSTROL3_P4 (SEQ ID NO:359) x MM11_HUMAN . . .
Alignment segment 1/1:
   Quality:                          4444.00
   Escore:                                 0
   Matching length:                      445
   Total length:                         445
   Matching Percent Similarity:        99.78
   Matching Percent Identity:          99.78
   Total Percent Similarity:           99.78
```

-continued

```
Total Percent Identity:           99.78
Gaps:                             0
Alignment:
```

```
  1  MAPAAWLRSAAARALLPPMLLLLQPPPLLARALPPDVHHLHAERRGPQP   50
     ||||||||||||||||||||||||||||||||||||||||||||||||||
  1  MAPAAWLRSAAARALLPPMLLLLQPPPLLARALPPDVHHLHAERRGPQP   50

51  WHAALPSSPAPAPATQEAPRPASSLRPPRCGVPDPSDGLSARNRQKRFVL  100
     ||||||||||||||||||||||||||||||||||||||||||||||||||
 51  WHAALPSSPAPAPATQEAPRPASSLRPPRCGVPDPSDGLSARNRQKRFVL  100

101  SGGRWEKTDLTYRILRFPWQLVQEQVRQTMAEALKVWSDVTPLTFTEVHE  150
     ||||||||||||||||||||||||||||||||||||||||||||||||||
101  SGGRWEKTDLTYRILRFPWQLVQEQVRQTMAEALKVWSDVTPLTFTEVHE  150

151  GRADIMIHFARYWDGDDLPFDGPGGILAHAFFPKTHREGDVHFDYDETWT  200
     |||||||  |||||||||||||||||||||||||||||||||||||||||
151  GRADIMIDFARYWDGDDLPFDGPGGILAHAFFPKTHREGDVHFDYDETWT  200

201  IGDDQGTDLLQVAAHEFGHVLGLQHTTAAKALMSAFYTFRYPLSLSPDDC  250
     ||||||||||||||||||||||||||||||||||||||||||||||||||
201  IGDDQGTDLLQVAAHEFGHVLGLQHTTAAKALMSAFYTFRYPLSLSPDDC  250

251  RGVQHLYGQPWPTVTSRTPALGPQAGIDTNEIAPLEPDAPPDACEASFDA  300
     ||||||||||||||||||||||||||||||||||||||||||||||||||
251  RGVQHLYGQPWPTVTSRTPALGPQAGIDTNEIAPLEPDAPPDACEASFDA  300

301  VSTIRGELFFFKAGFVWRLRGGQLQPGYPALASRHWQGLPSPVDAAFEDA  350
     ||||||||||||||||||||||||||||||||||||||||||||||||||
301  VSTIRGELFFFKAGFVWRLRGGQLQPGYPALASRHWQGLPSPVDAAFEDA  350

351  QGHIWFFQGAQYWVYDGEKPVLGPAPLTELGLVRFPVHAALVWGPEKNKI  400
     ||||||||||||||||||||||||||||||||||||||||||||||||||
351  QGHIWFFQGAQYWVYDGEKPVLGPAPLTELGLVRFPVHAALVWGPEKNKI  400

401  YFFRGRDYWRFHPSTRRVDSPVPRRATDWRGVPSEIDAAFQDADG       445
     |||||||||||||||||||||||||||||||||||||||||||||
401  YFFRGRDYWRFHPSTRRVDSPVPRRATDWRGVPSEIDAAFQDADG       445
```

```
Sequence name: MM11_HUMAN
Sequence documentation:
Alignment of: HSSTROL3_P5 (SEQ ID NO:360) x MM11_HUMAN . . .
Alignment segment 1/1:
Quality:                          3566.00
Escore:                           0
Matching length:                  358
Total length:                     358
Matching Percent Similarity:      99.72
Matching Percent Identity:        99.72
Total Percent Similarity:         99.72
Total Percent Identity:           99.72
Gaps:                             0
Alignment:
```

```
  1  MAPAAWLRSAAARALLPPMLLLLQPPPLLARALPPDVHHLHAERRGPQP   50
     ||||||||||||||||||||||||||||||||||||||||||||||||||
  1  MAPAAWLRSAAARALLPPMLLLLQPPPLLARALPPDVHHLHAERRGPQP   50

51  WHAALPSSPAPAPATQEAPRPASSLRPPRCGVPDPSDGLSARNRQKRFVL  100
     ||||||||||||||||||||||||||||||||||||||||||||||||||
 51  WHAALPSSPAPAPATQEAPRPASSLRPPRCGVPDPSDGLSARNRQKRFVL  100

101  SGGRWEKTDLTYRILRFPWQLVQEQVRQTMAEALKVWSDVTPLTFTEVHE  150
     ||||||||||||||||||||||||||||||||||||||||||||||||||
101  SGGRWEKTDLTYRILRFPWQLVQEQVRQTMAEALKVWSDVTPLTFTEVHE  150
```

```
151  GRADIMIDFARYWHGDDLPFDGPGGILAHAFFPKTHREGDVHFDYDETWT  250
     ||||||||||||| ||||||||||||||||||||||||||||||||||||
151  GRADIMIDFARYWDGDDLPFDGPGGILAHAFFPKTHREGDVHFDYDETWT  250

201  IGDDQGTDLLQVAAHEFGHVLGLQHTTAAKALMSAFYTFRYPLSLSPDDC  250
     ||||||||||||||||||||||||||||||||||||||||||||||||||
201  IGDDQGTDLLQVAAHEFGHVLGLQHTTAAKALMSAFYTFRYPLSLSPDDC  250

251  RGVQHLYGQPWPTVTSRTPALGPQAGIDTNEIAPLEPDAPPDACEASFDA  300
     ||||||||||||||||||||||||||||||||||||||||||||||||||
251  RGVQHLYGQPWPTVTSRTPALGPQAGIDTNEIAPLEPDAPPDACEASFDA  300

301  VSTIRGELFFFKAGFVWRLRGGQLQPGYPALASRHWQGLPSPVDAAFEDA  350
     ||||||||||||||||||||||||||||||||||||||||||||||||||
301  VSTIRGELFFFKAGFVWRLRGGQLQPGYPALASRHWQGLPSPVDAAFEDA  350

351  QGHIWFFQ  358
     ||||||||
351  QGHIWFFQ  358

Sequence name: MM11_HUMAN
Sequence documentation:
Alignment of: HSSTROL3_P7 (SEQ ID NO:361) x MM11_HUMAN . . .
Alignment segment 1/1:
Quality:                          3575.00
Escore:                                 0
Matching length:                      359
Total length:                         359
Matching Percent Similarity:        99.72
Matching Percent Identity:          99.72
Total Percent Similarity:           99.72
Total Percent Identity:             99.72
Gaps:                                   0
Alignment:

1  MAPAAWLRSAAARALLPPMLLLLLQPPPLLARALPPDVHHLHAERRGPQP   50
     ||||||||||||||||||||||||||||||||||||||||||||||||||
  1  MAPAAWLRSAAARALLPPMLLLLLQPPPLLARALPPDVHHLHAERRGPQP   50

51  WHAALPSSPAPAPATQEAPRPASSLRPPRCGVPDPSDGLSARNRQKRFVL  100
     ||||||||||||||||||||||||||||||||||||||||||||||||||
 51  WHAALPSSPAPAPATQEAPRPASSLRPPRCGVPDPSDGLSARNRQKRFVL  100

101  SGGRWEKTDLTYRILRFPWQLVQEQVRQTMAEALKVWSDVTPLTFTEVHE  150
     ||||||||||||||||||||||||||||||||||||||||||||||||||
101  SGGRWEKTDLTYRILRFPWQLVQEQVRQTMAEALKVWSDVTPLTFTEVHE  150

151  GRADIMIDFARYWHGDDLPFDGPGGILAHAFFPKTHREGDVHFDYDETWT  200
     ||||||||||||||||||||||||||||||||||||||||||||||||||
151  GRADIMIDFARYWHGDDLPFDGPGGILAHAFFPKTHREGDVHFDYDETWT  200

201  IGDDQGTDLLQVAAHEFGHVLGLQHTTAAKALMSAFYTFRYPLSLSPDDC  250
     ||||||||||||||||||||||||||||||||||||||||||||||||||
201  IGDDQGTDLLQVAAHEFGHVLGLQHTTAAKALMSAFYTFRYPLSLSPDDC  250

251  RGVQHLYGQPWPTVTSRTPALGPQAGIDTNEIAPLEPDAPPDACEASFDA  300
     ||||||||||||||||||||||||||||||||||||||||||||||||||
251  RGVQHLYGQPWPTVTSRTPALGPQAGIDTNEIAPLEPDAPPDACEASFDA  300

301  VSTIRGELFFFKAGFVWRLRGGQLQPGYPALASRHWQGLPSPVDAAFEDA  350
     ||||||||||||||||||||||||||||||||||||||||||||||||||
301  VSTIRGELFFFKAGFVWRLRGGQLQPGYPALASRHWQGLPSPVDAAFEDA  350

351  QGHIWFFQG  359
     |||||||||
351  QGHIWFFQG  359

Seqence name: MM11_HUMAN
Sequence documentation:
Alignment of: HSSTROL3_P8 (SEQ ID NO:362) x MM11_HUMAN . . .
```

```
Alignment segment 1/1:
Quality:                          2838.00
Escore:                                 0
Matching length:                      286
Total length:                         286
Matching Percent Similarity:        99.65
Matching Percent Identity:          99.65
Total Percent Similarity:           99.65
Total Percent Identity:             99.65
Gaps:                                   0
Alignment:

1  MAPAAWLRSAAARALLPPMLLLLLQPPPLLARALPPDVHHLHAERRGPQP   50
     ||||||||||||||||||||||||||||||||||||||||||||||||||
  1  MAPAAWLRSAAARALLPPMLLLLLQPPPLLARALPPDVHHLHAERRGPQP   50

51  WHAALPSSPAPAPATQEAPRPASSLRPPRCGVPDPSDGLSARNRQKRFVL  100
     ||||||||||||||||||||||||||||||||||||||||||||||||||
 51  WHAALPSSPAPAPATQEAPRPASSLRPPRCGVPDPSDGLSARNRQKRFVL  100

101  SGGRWEKTDLTYRILRFPWQLVQEQVRQTMAEALKVWSDVTPLTFTEVHE  150
     ||||||||||||||||||||||||||||||||||||||||||||||||||
101  SGGRWEKTDLTYRILRFPWQLVQEQVRQTMAEALKVWSDVTPLTFTEVHE  150

151  GRADIMIDFARYWHGDDLPFDGPGGILAHAFFPKTHREGDVHFDYDETWT  200
     ||||||||||||||||||||||||||||||||||||||||||||||||||
151  GRADIMIDFARYWHGDDLPFDGPGGILAHAFFPKTHREGDVHFDYDETWT  200

201  IGDDQGTDLLQVAAHEFGHVLGLQHTTAAKALMSAFYTFRYPLSLSPDDC  250
     ||||||||||||||||||||||||||||||||||||||||||||||||||
201  IGDDQGTDLLQVAAHEFGHVLGLQHTTAAKALMSAFYTFRYPLSLSPDDC  250

251  RGVQHLYGQPWPTVTSRTPALGPQAGIDTNEIAPLE               286
     |||||||||||||||||||||||||||||||||||
251  RGVQHLYGQPWPTVTSRTPALGPQAGIDTNEIAPLE               286

Sequence name: MM11_HUMAN
Sequence documentation:
Alignment of: HSSTROL3_P9 (SEQ ID NO:363) x MM11_HUMAN . . .
Alignment segment 1/1:
Quality:                          3316.00
Escore:                                 0
Matching length:                      343
Total length:                         359
Matching Percent Similarity:        99.71
Matching Percent Identity:          99.71
Total Percent Similarity:           95.26
Total Percent Identity:             95.26
Gaps:                                   1
Alignment:

1  MAPAAWLRSAAARALLPPMLLLLLQPPPLLARALPPDVHHLHAERRGPQP   50
     ||||||||||||||||||||||||||||||||||||||||||||||||||
  1  MAPAAWLRSAAARALLPPMLLLLLQPPPLLARALPPDVHHLHAERRGPQP   50

51  WHAALPSSPAPAPATQEAPRPASSLRPPRCGVPSDGLSARNRQK....    96
     |||||||||||||||||||||||||||||||||||||||||||
 51  WHAALPSSPAPAPATQEAPRPASSLRPPRCGVPDPSDGLSARNRQKRFVL  100

97  ...........RILRFPWQLVQEQVRQTMAEALKVWSDVTPLTFTEVHE  134
                |||||||||||||||||||||||||||||||||||||||
101  SGGRWEKTDLTYRILRFPWQLVQEQVRQTMAEALKVWSDVTPLTFTEVHE  150

135  GRADIMIDFARYWHGDDLPFDGPGGILAHAFFPKTHREGDVHFDYDETWT  184
     ||||||||||||||||||||||||||||||||||||||||||||||||||
151  GRADIMIDFARYWHGDDLPFDGPGGILAHAFFPKTHREGDVHFDYDETWT  200

185  IGDDQGTDLLQVAAHEFGHVLGLQHTTAAKALMSAFYTFRYPLSLSPDDC  234
     ||||||||||||||||||||||||||||||||||||||||||||||||||
201  IGDDQGTDLLQVAAHEFGHVLGLQHTTAAKALMSAFYTFRYPLSLSPDDC  250
```

```
235  RGVQHLYGQPWPTVTSRTPALGPQAGIDTNEIAPLEPDAPPDACEASFDA  284
     ||||||||||||||||||||||||||||||||||||||||||||||||||
251  RGVQHLYGQPWPTVTSRTPALGPQAGIDTNEIAPLEPDAPPDACEASFDA  300

285  VSTIRGELFFFKAGFVWRLRGGQLQPGYPALASRHWQGLPSPVDAAFEDA  334
     ||||||||||||||||||||||||||||||||||||||||||||||||||
301  VSTIRGELFFFKAGFVWRLRGGQLQPGYPALASRHWQGLPSPVDAAFEDA  350

335  QGHTWFFQG  344
     |||||||||
351  QGHTWFFQG  359
```

Expression of Stromelysin-3 Precursor (SEQ ID NO:391) (EC 3.4.24.-) (Matrix Metalloproteinase-11) (MMP-11) (ST3) (SL-3HSSTROL3) Transcripts Which are Detectable by Amplicon as Depicted in Sequence Name HSSTROL3 seg24 (SEQ ID NO:499) in Normal and Cancerous Prostate Tissues Expression of Stromelysin-3 precursor (SEQ ID NO:391) (EC 3.4.24.-) (Matrix metalloproteinase-11) (MMP-11) (ST3) (SL-3) transcripts detectable by or according to seg24, HSSTROL3 seg24 (SEQ ID NO:499) amplicon(s) and HSSTROL3 seg24F (SEQ ID NO:497) and HSSTROL3 seg24R (SEQ ID NO:498) primers was measured by real time PCR. In parallel the expression of four housekeeping genes—PBGD (GenBank Accession No. BC019323 (SEQ ID NO:509); amplicon—PBGD-amplicon (SEQ ID NO:404), HPRT1 (GenBank Accession No. NM_000194 (SEQ ID NO:510); amplicon—HPRT1-amplicon (SEQ ID NO:401), SDHA (GenBank Accession No. NM_004168 (SEQ ID NO:508); amplicon—SDHA-amplicon (SEQ ID NO:407), and RPL19 (GenBank Accession No. NM_000981 (SEQ ID NO:511); RPL19 amplicon (SEQ ID NO:410) was measured similarly. For each RT sample, the expression of the above amplicon was normalized to the geometric mean of the quantities of the housekeeping genes. The normalized quantity of each RT sample was then divided by the median of the quantities of the normal post-mortem (PM) samples (Sample Nos. 42, 48-53, 59-63, Table 1, "Tissue samples in testing panel", above), to obtain a value of fold up-regulation for each sample relative to median of the normal PM samples.

Figure 14:
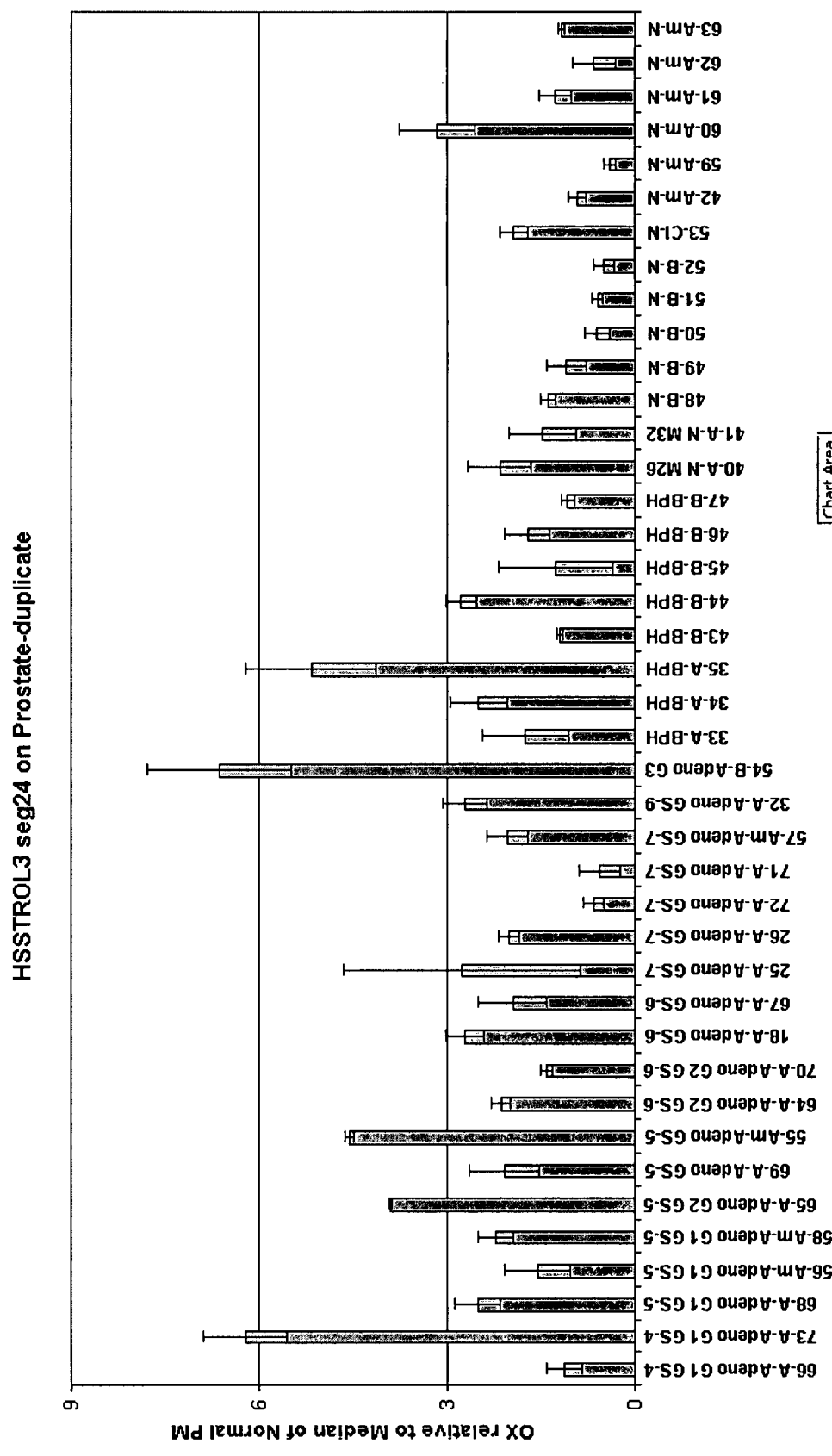
FIG. 14 is a histogram showing the over expression of the Stromelysin-3 precursor (SEQ ID NO:391) transcripts, which are detectable by amplicon as depicted in sequence name HSSTROL3 seg24 (SEQ ID NO:499), in cancerous Prostate samples relative to the normal samples.

FIG. 14 is a histogram showing over expression of the above-indicated Stromelysin-3 precursor (SEQ ID NO:391) transcripts in cancerous Prostate samples relative to the normal samples. Values represent the average of duplicate experiments. Error bars indicate the minimal and maximal values obtained.)

As is evident from FIG. 14, the expression of Stromelysin-3 precursor (SEQ ID NO:391) transcripts detectable by the above amplicon(s) in cancer samples was higher than in several non-cancerous samples (Sample Nos. 42, 48-53, 59-63, Table 1, "Tissue samples in testing panel"). Notably an over-expression of at least 3 fold was found in 4 out of 19 adenocarcinoma samples.

Statistical analysis was applied to verify the significance of these results, as described below.

The P value for the difference in the expression levels of Stromelysin-3 precursor (SEQ ID NO:391) transcripts detectable by the above amplicon(s) in Prostate cancer samples versus the normal tissue samples was determined by T test as 2.34E-03.

The above value demonstrate statistical significance of the results.

Primer pairs are also optionally and preferably encompassed within the present invention; for example, for the above experiment, the following primer pair was used as a non-limiting illustrative example only of a suitable primer pair: HSSTROL3 seg24F forward primer (SEQ ID NO:497); and HSSTROL3 seg24R reverse primer (SEQ ID NO:498).

The present invention also preferably encompasses any amplicon obtained through the use of any suitable primer pair; for example, for the above experiment, the following amplicon was obtained as a non-limiting illustrative example only of a suitable amplicon: HSSTROL seg24 (SEQ ID NO:499).

```
HSSTROL seg24 Forward primer (SEQ ID NO:497):
ATTTCCATCCTCAACTGGCAGA

HSSTROL seg24 Reverse primer (SEQ ID NO:498):
TGCCCTGGAACCCACG

HSSTROL seg24 Amplicon (SEQ ID NO:499):
ATTTCCATCCTCAACTGGCAGAGATGAGAGCCTGGAGCATTGCAGATGCC

AGGGACTTCAACAAATGAAGGCACAGCATGGGAAACCTGCGTGGGTTCCA

GGGCA
```

Expression of Stromelysin-3 Precursor (SEQ ID NO:391) Transcripts Which are Detectable by Amplicon as Depicted in Sequence Name HSSTROL3 seg24 (SEQ ID NO:499) in Different Normal Tissues Expression of Stromelysin-3 precursor (SEQ ID NO:391) transcripts detectable by or according to HSSTROL3 seg24 (SEQ ID NO:499) amplicon(s) and HSSTROL3 seg24F (SEQ ID NO:497) and HSSTROL3 seg24R (SEQ ID NO:498) was measured by real time PCR. In parallel the expression of four housekeeping genes Ubiquitin (GenBank Accession No. BC000449 (SEQ ID NO:516); amplicon—Ubiquitin-amplicon (SEQ ID NO:519) and SDHA (GenBank Accession No. NM_004168 (SEQ ID NO:508); amplicon—SDHA-amplicon (SEQ ID NO:407), RPL19 (GenBank Accession No. NM_000981 (SEQ ID NO:511); RPL19 amplicon (SEQ ID NO:410)), TATA box (GenBank Accession No. NM_003194 (SEQ ID NO:512); TATA amplicon (SEQ ID NO:515)) was measured similarly. For each RT sample, the expression of the above amplicon was normalized to the geometric mean of the quantities of the housekeeping genes. The normalized quantity of each RT sample was then divided by the median of the quantities of the lung samples (Sample Nos. 15-17, Table 2 "Tissue samples in normal panel", above), to obtain a value of relative expression of each sample relative to median of the lung samples.

Figure 15:
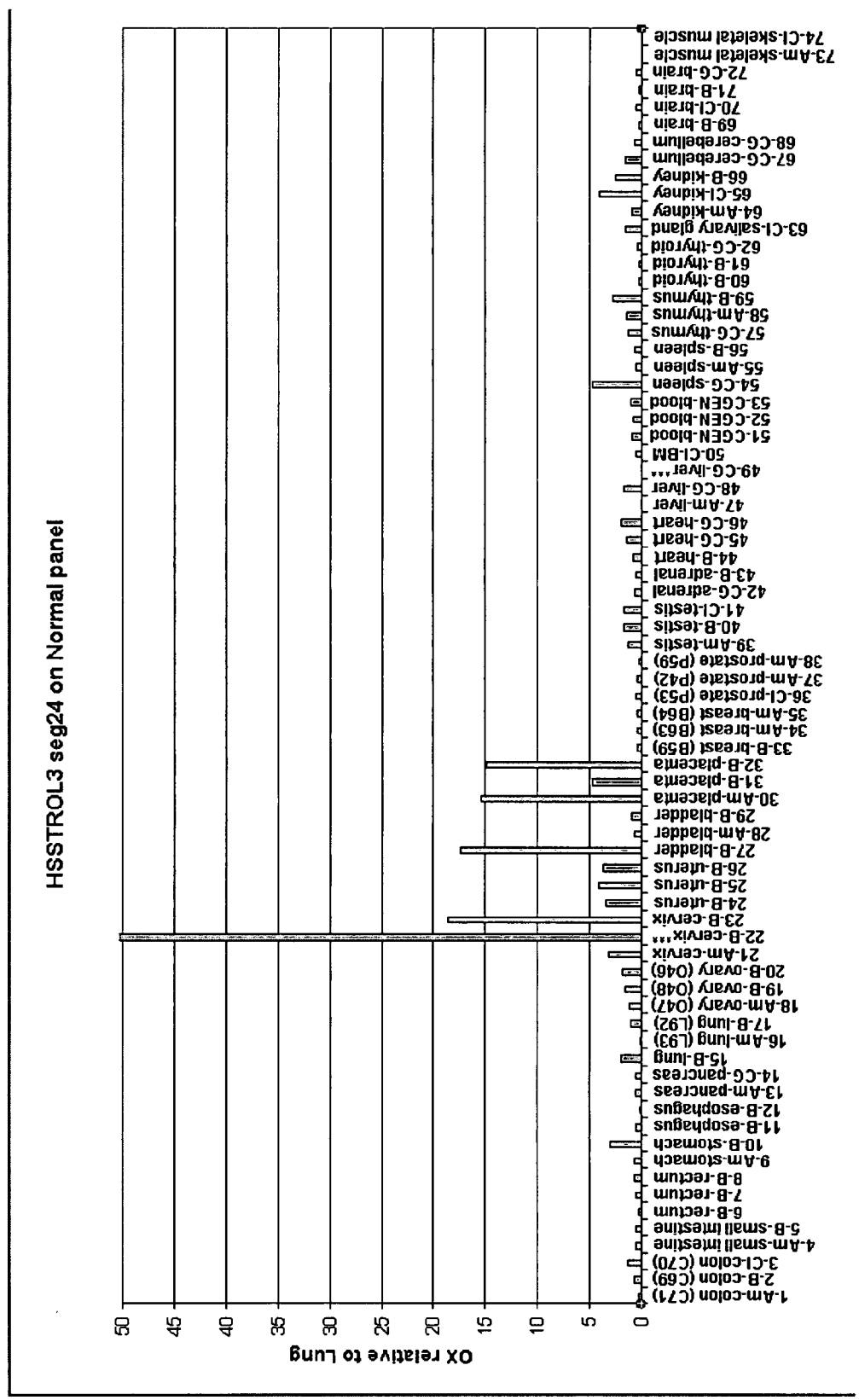
FIG. 15 is a histogram demonstrating the expression of Stromelysin-3 transcripts which are detectable by amplicon_as depicted in sequence name HSSTROL3 seg24 (SEQ ID NO:499) in different normal tissues.

The results are shown in FIG. 15, demonstrating the expression of Stromelysin-3 transcripts which are detectable by amplicon as depicted in sequence name HSSTROL3 seg24 (SEQ ID NO:499) in different normal tissues.

Description for Cluster HUMF5A

Cluster HUMF5A features 3 transcript(s) and 33 segment(s) of interest, the names for which are given in Tables 316 and 317, respectively, the sequences themselves are given at the end of the application. The selected protein variants are given in table 318.

TABLE 316

Transcripts of interest

| Transcript Name | Sequence ID No. |
| --- | --- |
| HUMF5A_PEA_1_T1 | 40 |
| HUMF5A_PEA_1_T3 | 41 |
| HUMF5A_PEA_1_T7 | 42 |

TABLE 317

Segments of interest

| Segment Name | Sequence ID No. |
| --- | --- |
| HUMF5A_PEA_1_node_0 | 238 |
| HUMF5A_PEA_1_node_4 | 239 |
| HUMF5A_PEA_1_node_6 | 240 |
| HUMF5A_PEA_1_node_8 | 241 |
| HUMF5A_PEA_1_node_10 | 242 |
| HUMF5A_PEA_1_node_12 | 243 |
| HUMF5A_PEA_1_node_14 | 244 |
| HUMF5A_PEA_1_node_18 | 245 |
| HUMF5A_PEA_1_node_21 | 246 |
| HUMF5A_PEA_1_node_22 | 247 |
| HUMF5A_PEA_1_node_24 | 248 |
| HUMF5A_PEA_1_node_26 | 249 |
| HUMF5A_PEA_1_node_27 | 250 |
| HUMF5A_PEA_1_node_29 | 251 |
| HUMF5A_PEA_1_node_35 | 252 |
| HUMF5A_PEA_1_node_37 | 253 |
| HUMF5A_PEA_1_node_39 | 254 |
| HUMF5A_PEA_1_node_47 | 255 |
| HUMF5A_PEA_1_node_50 | 256 |
| HUMF5A_PEA_1_node_53 | 257 |
| HUMF5A_PEA_1_node_56 | 258 |
| HUMF5A_PEA_1_node_60 | 259 |
| HUMF5A_PEA_1_node_2 | 260 |
| HUMF5A_PEA_1_node_16 | 261 |
| HUMF5A_PEA_1_node_31 | 262 |
| HUMF5A_PEA_1_node_32 | 263 |
| HUMF5A_PEA_1_node_33 | 264 |
| HUMF5A_PEA_1_node_41 | 265 |
| HUMF5A_PEA_1_node_43 | 266 |
| HUMF5A_PEA_1_node_45 | 267 |
| HUMF5A_PEA_1_node_51 | 268 |
| HUMF5A_PEA_1_node_57 | 269 |
| HUMF5A_PEA_1_node_59 | 270 |

TABLE 318

Proteins of interest

| Protein Name | Sequence ID No. | Corresponding Transcript(s) |
| --- | --- | --- |
| HUMF5A_PEA_1_P3 | 364 | HUMF5A_PEA_1_T1 (SEQ ID NO:40) |

TABLE 318-continued

Proteins of interest

| Protein Name | Sequence ID No. | Corresponding Transcript(s) |
| --- | --- | --- |
| HUMF5A_PEA_1_P4 | 365 | HUMF5A_PEA_1_T3 (SEQ ID NO:41) |
| HUMF5A_PEA_1_P8 | 366 | HUMF5A_PEA_1_T7 (SEQ ID NO:42) |

These sequences are variants of the known protein Coagulation factor V precursor (SEQ ID NO:392) (SwissProt accession identifier FA5_HUMAN (SEQ ID NO: 392); known also according to the synonyms Activated protein C cofactor), SEQ ID NO: 392, referred to herein as the previously known protein.

Protein Coagulation factor V precursor (SEQ ID NO:392) is known or believed to have the following function(s): Coagulation factor V is a cofactor that participates with factor Xa to activate prothrombin to thrombin. The sequence for protein Coagulation factor V precursor (SEQ ID NO:392) is given at the end of the application, as "Coagulation factor V precursor (SEQ ID NO:392) amino acid sequence". Known polymorphisms for this sequence are as shown in Table 319.

TABLE 319

Amino acid mutations for Known Protein

| SNP position(s) on amino acid sequence | Comment |
| --- | --- |
| 107 | D -> H (in dbSNP: 6019). /FTId=VAR_013886. |
| 334 | R -> G (in APCR; Hong Kong). /FTId=VAR_013620. |
| 334 | R -> T (in APCR; Cambridge). /FTId=VAR_013621. |
| 413 | M -> T (in dbSNP: 6033). /FTId=VAR_013887. |
| 513 | R -> K (in dbSNP: 6020). /FTId=VAR_013622. |
| 534 | R -> Q (in APCR; Leiden; dbSNP: 6025). /FTId=VAR_001213. |
| 809 | P -> S (in dbSNP: 6031). /FTId=VAR_013888. |
| 817 | N -> T (in dbSNP: 6018). /FTId=VAR_013889. |
| 858 | K -> R (in dbSNP: 4524). /FTId=VAR_001214. |
| 865 | H -> R (in dbSNP: 4525). /FTId=VAR_001215. |
| 925 | K -> E (in dbSNP: 6032). /FTId=VAR_013890. |
| 1146 | H -> Q (in dbSNP: 6005). /FTId=VAR_013891. |
| 1285 | L -> I (in dbSNP: 1046712). /FTId=VAR_013892. |
| 1327 | H -> R (in dbSNP: 1800595). /FTId=VAR_013893. |
| 1530 | E -> A (in dbSNP: 6007). /FTId=VAR_013894. |
| 1685 | T -> S (in dbSNP: 6011). /FTId=VAR_013895. |
| 1749 | L -> V (in dbSNP: 6034). /FTId=VAR_013896. |
| 1764 | V -> M (in dbSNP: 6030). /FTId=VAR_013897. |
| 1820 | M -> I (in dbSNP: 6026). /FTId=VAR_013898. |
| 2102 | R -> H (in APCR). /FTId=VAR_017329. |
| 2222 | D -> G (in dbSNP: 6027). /FTId=VAR_013899. |
| 2213 | T -> A |

The following GO Annotation(s) apply to the previously known protein. The following annotation(s) were found: cell adhesion; blood coagulation, which are annotation(s) related to Biological Process; and blood coagulation factor; copper binding, which are annotation(s) related to Molecular Function.

The GO assignment relies on information from one or more of the SwissProt/TremB1 Protein knowledgebase, available from expasydotch/sprot/; or Locuslink, available from ncbidotnlmdotnihgov/projects/LocusLink/.

As noted above, cluster HUMF5A features 3 transcript(s), which were listed in Table 316 above. These transcript(s) encode for protein(s) which are variant(s) of protein Coagulation factor V precursor (SEQ ID NO:392). A description of each variant protein according to the present invention is now provided.

Variant protein HUMF5A_PEA_1_P3 (SEQ ID NO:364) according to the present invention has an amino acid sequence as given at the end of the application; it is encoded by transcript(s) HUMF5A_PEA_1_T1 (SEQ ID NO:40). An alignment is given to the known protein (Coagulation factor V precursor (SEQ ID NO:392)) at the end of the application. One or more alignments to one or more previously published protein sequences are given at the end of the application. A brief description of the relationship of the variant protein according to the present invention to each such aligned protein is as follows:

Comparison report between HUMF5A_PEA_1_P3 (SEQ ID NO:364) and FA5_HUMAN_V1 (SEQ ID NO:393):

1. An isolated chimeric polypeptide encoding for HUMF5A_PEA_1_P3 (SEQ ID NO:364), comprising a first amino acid sequence being at least 90% homologous to MFPGCPRLWVLVVLGTSWVGWGSQGTEAAQLRQFYVAAQGISWSYRPEPTNSSLNLS VTSFKKIVYREYEPYFKKEKPQSTISGLLGPTLYAEVGDIIKVHFKNKADKPLSIHPQGIR YSKLSEGASYLDHTFPAEKMDDAVAPGREYTYEWSISEDSGPTHDDPPCLTHIYYSHEN LIEDFNSGLIGPLLICKKGTLTEGGTQKTFDKQIVLLFAVFDESKSWSQSSSLMYTVNGY VNGTMPDITVCAHDHISWHLLGMSSGPELFSIHFNGQVLEQNHHKVSAITLVSATSTTA NMTVGPEGKWIIS SLTPKHLQAGMQAYIDIKNCPKKTRNLKKITREQRRHMKRWEYFI AAEEVIWDYAPVIPANMDKKYRSQHLDNFSNQIGKHYKKVMYTQYEDESFTKHTVNP NMKEDGILGPIIRAQVRDTLKIVFKNMASRPYSIYPHGVTFSPYEDEVNSSFTSGRNNTM IRAVQPGETYTYKWNILEFDEPTENDAQCLTRPYYSDVDIMRDIASGLIGLLLICKSRSL DRRGIQRAADIEQQAVFAVFDENKSWYLEDNINKFCENPDEVKRDDPKFYESNIMSTIN GYVPESITTLGFCFDDTVQWHFCSVGTQNEILTIHFTGHSFIYGKRHEDTLTLFPMRGES VTVTMDNVGTWMLTSMNSSPRSKKLRLKFRDVKCIPDDDEDSYEIFEPPESTVMATRK MHDRLEPEDEESDADYDYQNRLAAALGIRSFRNSSLNQEEEEFNLTALALENGTEFVSS NTDIIVGSNYSSPSNISKFTVNNLAEPQKAPSHQQATTAGSPLRHLIGKNSVLNSSTAEHS SPYSEDPIEDPLQPDVTGIRLLSLGAGEFRSQEHAKRKGPKVERDQAAKHRFSWMKLLA HKVGRHLSQDTGSPSGMRPWEDLPSQDTGSPSRMRPWKDPPSDLLLLKQSNSSKILVG RWHLASEKGSYEIIQDTDEDTAVNNWLISPQNASRAWGESTPLANKPGKQSGHPKF PR VRHKSLQVRQDGGKSRLKKSQFLIKTRKKKKEKHTHHAPLSPRTFHPLRSEAYNTFSER RLKHSLVLHKSNETSLPTDLNQTLPSMDFGWIASLPDHNQNSSNDTGQASCPPGLYQTV PPEEHYQTFPIQDPDQMHSTSDPSHRSSSPELSEMLEYDRSHKSFPTDISQMSPSSEHEV WQTVISPDLSQVTLSPELSQTNLSPDLSHTTLSPELIQRNLSPALGQMPISPDLSHTTLSPD LSHTTLSLDLSQTNLSPELSQTNLSPALGQMPLSPDLSHTTLSLDFSQTNLSPELSHMTLS PELSQTNLSPALGQMPISPDLSHTTLSLDFSQTNLSPELSQTNLSPALGQMPLSPDPSHTT LSLDLSQTNLSPELSQTNLSPDLSEMPLFADLSQIPLTPDLDQMTLSPDLGETDLSPNFGQ MSLSPDLSQVTLSPDISDTTLLPDLSQISPPPDLDQIFYPSESSQSLLLQEFNESFPYPDLGQ MPSPSSPTLNDTFLSKEFNPLVIVGLSKDGTDYIEIIPKEEVQSSEDDYAEIDYVPYDDPY KTDVRTNINSSRDPDNIAAWYLRSNNGNRRNYYIAAEEISWDYSEFVQRETDIEDSDDIP EDTTYKK corresponding to amino acids 1-1617 of FA5_HUMAN_V1 (SEQ ID NO:393), which also corresponds to amino acids 1-1617 of HUMF5A_PEA_1_P3 (SEQ ID NO:364), and a second amino acid sequence being at least 70%, optionally at least 80%, preferably at least 85%, more preferably at least 90% and most preferably at least 95% homologous to a polypeptide having the sequence GSMKSISEFLVLLSELKWMMLSKFVLKI (SEQ ID NO: 569) corresponding to amino acids 1618-1645 of HUMF5A_PEA_1_P3 (SEQ ID NO:364), wherein said first amino acid sequence and second amino acid sequence are contiguous and in a sequential order.

2. An isolated polypeptide encoding for a tail of HUMF5A_PEA_1_P3 (SEQ ID NO:364), comprising a polypeptide being at least 70%, optionally at least about 80%, preferably at least about 85%, more preferably at least about 90% and most preferably at least about 95% homologous to the sequence GSMKSISEFLVLLSELKWMMLSKFVLKI (SEQ ID NO: 569) in HUMF5A_PEA_1_P3 (SEQ ID NO:364).

It should be noted that the known protein sequence (FA5 HUMAN) has one or more changes than the sequence given at the end of the application and named as being the amino acid sequence for FA5_HUMAN_V1 (SEQ ID NO:393). These changes were previously known to occur and are listed in the table below.

TABLE 320

Changes to FA5_HUMAN_V1 (SEQ ID NO:393)

| SNP position(s) on amino acid sequence | Type of change |
|---|---|
| 859 | Variant |
| 866 | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMF5A_PEA_1_P3 (SEQ ID NO:364) also has the following non-silent SNPs (Single Nucleotide Polymorphisms) as listed in Table 321, (given according to their position(s) on the amino acid sequence, with the alternative amino acid(s) listed; the last column indicates whether the SNP is known or not; the presence of known SNPs in variant protein HUMF5A_PEA_1_P3 (SEQ ID NO:364) sequence provides support for the deduced sequence of this variant protein according to the present invention).

TABLE 321

Amino acid mutations

| SNP position(s) on amino acid sequence | Alternative amino acid(s) | Previously known SNP? |
|---|---|---|
| 15 | G -> S | Yes |
| 107 | D -> H | Yes |
| 413 | M -> T | Yes |
| 513 | R -> K | Yes |
| 534 | R -> Q | Yes |
| 781 | S -> R | Yes |
| 809 | P -> S | Yes |
| 817 | N -> T | Yes |
| 858 | R -> K | Yes |
| 865 | R -> H | Yes |
| 915 | T -> S | Yes |
| 925 | K -> E | Yes |
| 969 | N -> S | Yes |
| 980 | R -> L | Yes |
| 1146 | H -> Q | Yes |
| 1169 | D -> | No |
| 1285 | L -> I | Yes |
| 1327 | H -> R | Yes |
| 1397 | L -> F | Yes |
| 1404 | P -> S | Yes |
| 1530 | E -> A | Yes |

Variant protein HUMF5A_PEA_1_P3 (SEQ ID NO:364) is encoded by the following transcript(s): HUMF5A_PEA_1_T1 (SEQ ID NO:40), for which the sequence(s) is/are given at the end of the application. The coding portion of transcript HUMF5A_PEA_1_T1 (SEQ ID NO:40) is shown in bold; this coding portion starts at position 183 and ends at position 5117. The transcript also has the following SNPs as listed in Table 322 (given according to their position on the nucleotide sequence, with the alternative nucleic acid listed; the last column indicates whether the SNP is known or not; the presence of known SNPs in variant protein HUMF5A_PEA_1_P3 (SEQ ID NO:364) sequence provides support for the deduced sequence of this variant protein according to the present invention).

TABLE 322

Nucleic acid SNPs

| SNP position on nucleotide sequence | Alternative nucleic acid | Previously known SNP? |
|---|---|---|
| 16 | C -> T | Yes |
| 225 | G -> A | Yes |
| 419 | A -> G | Yes |
| 501 | G -> C | Yes |
| 587 | G -> A | Yes |
| 734 | G -> T | Yes |
| 746 | G -> C | Yes |
| 951 | C -> T | Yes |
| 998 | C -> T | Yes |
| 1420 | T -> C | Yes |
| 1424 | A -> G | Yes |
| 1562 | C -> T | Yes |
| 1720 | G -> A | Yes |
| 1783 | G -> A | Yes |
| 1898 | G -> A | Yes |
| 2102 | C -> T | Yes |
| 2108 | C -> A | Yes |
| 2390 | T -> C | Yes |
| 2417 | C -> T | Yes |
| 2471 | A -> G | Yes |
| 2483 | G -> A | Yes |
| 2525 | T -> G | Yes |
| 2607 | C -> T | Yes |
| 2632 | A -> C | Yes |
| 2755 | G -> A | Yes |
| 2776 | G -> A | Yes |
| 2925 | A -> T | Yes |
| 2955 | A -> G | Yes |
| 3088 | A -> G | Yes |
| 3121 | G -> T | Yes |
| 3437 | A -> G | Yes |
| 3620 | C -> G | Yes |
| 3686 | A -> C | Yes |
| 3688 | A -> | No |
| 3689 | T -> | No |
| 3764 | C -> T | Yes |
| 3986 | T -> C | Yes |
| 4035 | C -> A | Yes |
| 4130 | C -> T | Yes |
| 4162 | A -> G | Yes |
| 4277 | C -> T | Yes |
| 4371 | C -> T | Yes |
| 4392 | C -> T | Yes |
| 4771 | A -> C | Yes |
| 5152 | A -> G | Yes |
| 5184 | C -> G | Yes |
| 5375 | C -> G | Yes |
| 5420 | G -> A | Yes |
| 5590 | G -> A | Yes |
| 6573 | T -> C | Yes |
| 6684 | A -> G | Yes |
| 6795 | A -> G | Yes |

Variant protein HUMF5A_PEA_1_P4 (SEQ ID NO:365) according to the present invention has an amino acid sequence as given at the end of the application; it is encoded by transcript(s) HUMF5A_PEA_1_T3 (SEQ ID NO:41). An alignment is given to the known protein (Coagulation factor V precursor (SEQ ID NO:392)) at the end of the application. One or more alignments to one or more previously published protein sequences are given at the end of the application. A brief description of the relationship of the variant protein according to the present invention to each such aligned protein is as follows:

Comparison report between HUMF5A_PEA_1_P4 (SEQ ID NO:365) and FA5_HUMAN_V1 (SEQ ID NO:393):

1. An isolated chimeric polypeptide encoding for HUMF5A_PEA_1_P4 (SEQ ID NO:365), comprising a first amino acid sequence being at least 90% homologous to MFPGCPRLWVLVVLGTSWVGWG-SQGTEAAQLRQFYVAAQGISWSYRPEPTNSSLNLS VTSFKKIVYREYEPYFKKEKPQSTIS-GLLGPTLYAEVGDIIKVHFKNKADKPLSIHPQGIR YSKLSEGASYLDHTFPAEKMD-DAVAPGREYTYEWSISEDSGPTHDDPP-CLTHIYYSHEN LIEDFNSGLIGPLLICKKGTLTEG-GTQKTFDKQIVLLFAVFDESKSWSQSSSLMYTVNGY VNGTMPDITVCAHDHISWHLLGMSSG-PELFSIHFNGQVLEQNHHKVSAITLVSATSTTA NMTVPGEGKWIISSLTPKHLQAGMQAY-IDIKNCPKKTRNLKKITREQRRHMKRWEYFI AAEEVIWDYAPVIPANMDKKYRSQHLDN-FSNQIGKHYKKVMYTQYEDESFTKHTVNP NMKEDGILGPIIRAQVRDTLKIVFKN-MASRPYSIYPHGVTFSPYEDEVNSSFTSGRNNTM IRAVQPGETYTYKWNILEFDEPTENDAQ-CLTRPYYSDVDIMRDIASGLIGLLLICKSRSL DRRGIQRAADIEQQAVFAVFDENKSW-YLEDNINKFCENPDEVKRDDPKFYESNIMSTIN GYVPESITTLGFCFDDTVQWHFCSVGTQ- NEILTIHFTGHSFIYGKRHEDTLTLFPMRGES VTVTMDNVGTWMLTSMNSSPRSKKLRLKFRDVKClPDDDEDSYEIFEPPESTVMATRK MHDRLEPEDEESDADYDYQNRLAAAL-GIRSFRNSSLNQEEEEFNLTALALENGTEFVSS NTDI-IVGSNYSSPSNISKFTVNNLAEPQKAPSHQQATTAGSPLRHLIGKNSVLNSSTAEHS SPYSEDPIEDPLQPDVTGIRLLSLGAGEFRSQEHAKRKGPKVERDQAAKHRFSWMKLLA HKVGRHLSQDTGSPSGMRPWEDLPSQDTGSPSRMRPWKDPPSDLLLLKQSNSSKILVG RWHLASEKGSYEIIQDTDEDTAVNNWLISPQNASRAWGESTPLANKPGKQSGHPK FPR VRHKSLQVRQDGGKSRLKKSQFLIKTRKKKKEKHTHHAPLSPRTFHPLRSEAYNTFSER RLKHSLVLHKSNETSLPTDLNQTLPSMDFGWIASLPDHNQNSSNDTGQASCPPGLYQTV PPEEHYQTFPIQDPDQMHSTSDPSHRSSSPELSEMLEYDRSHKSFPTDISQMSPSSEHEV WQTVISPDLSQVTLSPELSQTNLSPDLSHTTLSPELIQRNLSPALGQMPISPDLSHTTLSPD LSHTTLSLDLSQTNLSPELSQTNLSPALGQMPLSPDLSHTTLSLDFSQTNLSPELSHMTLS PELSQTNLSPALGQMPISPDLSHTTLSLDFSQTNLSPELSQTNLSPALGQMPLSPDPSHTT LSLDLSQTNLSPELSQTNLSPDLSEMPLFADLSQIPLTPDLDQMTLSPDLGETDLSPNFGQ MSLSPDLSQVTLSPDISDTTLLPDLSQISPPPDLDQIFYPSESSQSLLLQEFNESFPYPDLGQ MPSPSSPTLNDTFLSKEFNPLVIVGLSKDGTDYIEIIPKEEVQSSEDDYAEIDYVPYDDPY KTDVRTNINSSRDPDNIAAWYLRSNNGNRRNYYIAAEEISWDYSEFVQRETDIEDSDDIP EDTTYKKVVFRKYLDSTFTKRDPRGEYEEHLGILGPIIRAEVDDVIQVRFKNLASRPYSL HAHGLSYEKSSEGKTYEDDSPEWFKEDNAVQPNSSYTYVWHATERSGPESPGSACRA WAYYSAVNPEKDIHSGLIGPLLICQKGILHKDSNMPVDMREFVLLFMTFDEKKSWYYE KKSRSSWRLTSSEMKKSHEFHAINGMIYSLPGLKMYEQEWVRLHLLNIGGSQDIHVVH FHGQTLLENGNKQHQLGVWPLLPGSFKTLEMKASKPGWWLLNTEVGENQRAGMQTP FLIMDRDCRMPMGLSTGIISDSQIKASEFLGYWEPRLARLNNGGSYNAWSVEKLAAEFA SKPWIQVDMQKEVIITGIQTQGAKHYLKSCYTTEFYVAYSSNQINWQIFKGNSTRNVMY FNGNSDASTIKENQFDPPIVARYIRISPTRAYNRPTLRLELQGCE corresponding to amino acids 1-2062 of FA5_HUMAN_V1 (SEQ ID NO:393), which also corresponds to amino acids 1-2062 of HUMF5A_PEA_1_P4 (SEQ ID NO:365), and a second amino acid sequence being at least 70%, optionally at least 80%, preferably at least 85%, more preferably at least 90% and most preferably at least 95% homologous to a polypeptide having the sequence DVPHPWVWKMER (SEQ ID NO: 570) corresponding to amino acids 2063-2074 of HUMF5A_PEA_1_P4 (SEQ ID NO:365), wherein said first amino acid sequence and second amino acid sequence are contiguous and in a sequential order.

2. An isolated polypeptide encoding for a tail of HUMF5A_PEA_1_P4 (SEQ ID NO:365), comprising a polypeptide being at least 70%, optionally at least about 80%, preferably at least about 85%, more preferably at least about 90% and most preferably at least about 95% homologous to the sequence DVPHPWVWKMER (SEQ ID NO: 570) in HUMF5A_PEA_1_P4 (SEQ ID NO:365).

It should be noted that the known protein sequence (FA5_HUMAN) has one or more changes than the sequence given at the end of the application and named as being the amino acid sequence for FA5_HUMAN_V1 (SEQ ID NO:393). These changes were previously known to occur and are listed in the table below.

TABLE 323

Changes to FA5_HUMAN_V1 (SEQ ID NO:393)

| SNP position(s) on amino acid sequence | Type of change |
|---|---|
| 859 | Variant |
| 866. | Variant |

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMF5A_PEA_1_P4 (SEQ ID NO:365) also has the following non-silent SNPs (Single Nucleotide Polymorphisms) as listed in Table 324, (given according to their position(s) on the amino acid sequence, with the alternative amino acid(s) listed; the last column indicates whether the SNP is known or not; the presence of known SNPs in variant protein HUMF5A_PEA_1_P4 (SEQ ID NO:365) sequence provides support for the deduced sequence of this variant protein according to the present invention).

TABLE 324

Amino acid mutations

| SNP position(s) on amino acid sequence | Alternative amino acid(s) | Previously known SNP? |
|---|---|---|
| 15 | G -> S | Yes |
| 107 | D -> H | Yes |
| 413 | M -> T | Yes |
| 513 | R -> K | Yes |
| 534 | R -> Q | Yes |
| 781 | S -> R | Yes |
| 809 | P -> S | Yes |
| 817 | N -> T | Yes |
| 858 | R -> K | Yes |
| 865 | R -> H | Yes |
| 915 | T -> S | Yes |
| 925 | K -> E | Yes |
| 969 | N -> S | Yes |
| 980 | R -> L | Yes |
| 1146 | H -> Q | Yes |
| 1169 | D -> | No |
| 1285 | L -> I | Yes |
| 1327 | H -> R | Yes |
| 1397 | L -> F | Yes |
| 1404 | P -> S | Yes |
| 1530 | E -> A | Yes |
| 1685 | T -> S | Yes |
| 1749 | L -> V | Yes |
| 1764 | V -> M | Yes |
| 1820 | M -> I | Yes |

Variant protein HUMF5A_PEA_1_P4 (SEQ ID NO:365) is encoded by the following transcript(s): HUMF5A_PEA_1_T3 (SEQ ID NO:41), for which the sequence(s) is/are given at the end of the application. The coding portion of transcript HUMF5A_PEA_1_T3 (SEQ ID NO:41) is shown in bold; this coding portion starts at position 183 and ends at position 6404. The transcript also has the following SNPs as listed in Table 325 (given according to their position on the nucleotide sequence, with the alternative nucleic acid listed; the last column indicates whether the SNP is known or not; the presence of known SNPs in variant protein HUMF5A_PEA_1_P4 (SEQ ID NO:365) sequence provides support for the deduced sequence of this variant protein according to the present invention).

TABLE 325

Nucleic acid SNPs

| SNP position on nucleotide sequence | Alternative nucleic acid | Previously known SNP? |
|---|---|---|
| 16 | C -> T | Yes |
| 225 | G -> A | Yes |
| 419 | A -> G | Yes |
| 501 | G -> C | Yes |
| 587 | G -> A | Yes |
| 734 | G -> T | Yes |
| 746 | G -> C | Yes |
| 951 | C -> T | Yes |
| 998 | C -> T | Yes |
| 1420 | T -> C | Yes |
| 1424 | A -> G | Yes |
| 1562 | C -> T | Yes |
| 1720 | G -> A | Yes |
| 1783 | G -> A | Yes |
| 1898 | G -> A | Yes |
| 2102 | C -> T | Yes |
| 2108 | C -> A | Yes |
| 2390 | T -> C | Yes |
| 2417 | C -> T | Yes |
| 2471 | A -> G | Yes |
| 2483 | G -> A | Yes |
| 2525 | T -> G | Yes |
| 2607 | C -> T | Yes |
| 2632 | A -> C | Yes |
| 2755 | G -> A | Yes |
| 2776 | G -> A | Yes |
| 2925 | A -> T | Yes |
| 2955 | A -> G | Yes |
| 3088 | A -> G | Yes |
| 3121 | G -> T | Yes |
| 3437 | A -> G | Yes |
| 3620 | C -> G | Yes |
| 3686 | A -> C | Yes |
| 3688 | A -> | No |
| 3689 | T -> | No |
| 3764 | C -> T | Yes |
| 3986 | T -> C | Yes |
| 4035 | C -> A | Yes |
| 4130 | C -> T | Yes |
| 4162 | A -> G | Yes |
| 4277 | C -> T | Yes |
| 4371 | C -> T | Yes |
| 4392 | C -> T | Yes |
| 4771 | A -> C | Yes |
| 5204 | A -> G | Yes |
| 5236 | C -> G | Yes |
| 5427 | C -> G | Yes |
| 5472 | G -> A | Yes |
| 5642 | G -> A | Yes |
| 6618 | T -> C | Yes |
| 6729 | A -> G | Yes |
| 6840 | A -> G | Yes |

Variant protein HUMF5A_PEA_1_P8 (SEQ ID NO:366) according to the present invention has an amino acid sequence as given at the end of the application; it is encoded by transcript(s) HUMF5A_PEA_1_T7 (SEQ ID NO:42). An alignment is given to the known protein (Coagulation factor V precursor (SEQ ID NO:392)) at the end of the application. One or more alignments to one or more previously published protein sequences are given at the end of the application. A brief description of the relationship of the variant protein according to the present invention to each such aligned protein is as follows:

Comparison report between HUMF5A_PEA_1_P8 (SEQ ID NO:366) and FA5_HUMAN:

1. An isolated chimeric polypeptide encoding for HUMF5A_PEA_1_P8 (SEQ ID NO:366), comprising a first amino acid sequence being at least 90% homologous to MFPGCPRLWVLVVLGTSWVGWG-SQGTEAAQLRQFYVAAQGISWSYRPEPTNSSLNLS VTSFKKIVYREYEPYFKKEKPQSTIS-GLLGPTLYAEVGDIIKVHFKNKADKPLSIHPQGIR YSKLSEGASYLDHTFPAEKMD-DAVAPGREYTYEWSISEDSGPTHDDPP-CLTHIYYSHEN LIEDFNSGLIGPLLICKKGTLTEG-GTQKTFDKQIVLLFAVFDESKSWSQSSSLMYTVNGY VNGTMPDITVCAHDHISWHLLGMSSG-PELFSIHFNGQVLEQNHHKVSAITLVSATSTTA NMTVGPEGKWIISSLTPKHLQAGMQAY-IDIKNCPKKTRNLKKITREQRRHMKRWEYFI AAEEVIWDYAPVIPANMDKKYRSQHLDN-FSNQIGKHYKKVMYTQYEDESFTKHTVNP NMKEDGILGPIIRAQVRDTLKIVFKN-MASRPYSIYPHGVTFSPYEDEVNSSFTSGRNNTM IRAVQPGETYTYKWNILEFDEPTENDAQ-CLTRPYYSDVDIMRDIASGLIGLLLICKSRSL DRRGIQRAADIEQQAVFAVFDENKSW-YLEDNINKFCENPDEVKRDDPKFYESNIMS corresponding to amino acids 1-587 of FA5_HUMAN, which also corresponds to amino acids 1-587 of HUMF5A_PEA_1_P8 (SEQ ID NO:366), and a second amino acid sequence being at least 70%, optionally at least 80%, preferably at least 85%, more preferably at least 90% and most preferably at least 95% homologous to a polypeptide having the sequence SKSEYYFCSSVFHSCG (SEQ ID NO: 571) corresponding to amino acids 588-603 of HUMF5A_PEA_1_P8 (SEQ ID NO:366), wherein said first amino acid sequence and second amino acid sequence are contiguous and in a sequential order.

2. An isolated polypeptide encoding for a tail of HUMF5A_PEA_1_P8 (SEQ ID NO:366) comprising a polypeptide being at least 70%, optionally at least about 80%, preferably at least about 85%, more preferably at least about 90% and most preferably at least about 95% homologous to the sequence SKSEYYFCSSVFHSCG (SEQ ID NO: 571) in HUMF5A_PEA_1_P8 (SEQ ID NO:366).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HUMF5A_PEA_1_P8 (SEQ ID NO:366) also has the following non-silent SNPs (Single Nucleotide Polymorphisms) as listed in Table 326, (given according to their position(s) on the amino acid sequence, with the alternative amino acid(s) listed; the last column indicates whether the SNP is known or not; the presence of known SNPs in variant protein HUMF5A_PEA_1_P8 (SEQ ID NO:366) sequence provides support for the deduced sequence of this variant protein according to the present invention).

TABLE 326

Amino acid mutations

| SNP position(s) on amino acid sequence | Alternative amino acid(s) | Previously known SNP? |
|---|---|---|
| 15 | G -> S | Yes |
| 107 | D -> H | Yes |
| 413 | M -> T | Yes |
| 513 | R -> K | Yes |
| 534 | R -> Q | Yes |

The glycosylation sites of variant protein HUMF5A_PEA_1_P8 (SEQ ID NO:366), as compared to the known protein Coagulation factor V precursor (SEQ ID NO:392), are described in Table 327 (given according to their position(s) on the amino acid sequence in the first column; the second column indicates whether the glycosylation site is present in the variant protein; and the last column indicates whether the position is different on the variant protein).

TABLE 327

Glycosylation site(s)

| Position(s) on known amino acid sequence | Present in variant protein? | Position in variant protein? |
|---|---|---|
| 821 | No | |
| 554 | Yes | 554 |
| 1703 | No | |
| 741 | No | |
| 55 | Yes | 55 |
| 297 | Yes | 297 |
| 752 | No | |
| 468 | Yes | 468 |
| 460 | Yes | 460 |
| 1559 | No | |
| 782 | No | |
| 1479 | No | |
| 938 | No | |
| 776 | No | |
| 760 | No | |
| 1103 | No | |
| 1499 | No | |
| 1106 | No | |
| 977 | No | |
| 2010 | No | |
| 239 | Yes | 239 |
| 1074 | No | |
| 2209 | No | |
| 1083 | No | |
| 51 | Yes | 51 |
| 382 | Yes | 382 |

The phosphorylation sites of variant protein HUMF5A_PEA_1_P8 (SEQ ID NO:366), as compared to the known protein Coagulation factor V precursor (SEQ ID NO:392), are described in Table 328 (given according to their position(s) on the amino acid sequence in the first column; the second column indicates whether the phosphorylation site is present in the variant protein; and the last column indicates whether the position is different on the variant protein).

TABLE 328

Phosphorylation site(s)

| Position(s) on known amino acid sequence | Present in variant protein? | Position in variant protein? |
|---|---|---|
| 724 | No | |
| 726 | No | |
| 1543 | No | |
| 1538 | No | |
| 693 | No | |
| 1593 | No | |
| 1522 | No | |

Variant protein HUMF5A_PEA_1_P8 (SEQ ID NO:366) is encoded by the following transcript(s): HUMF5A_PEA_1_T7 (SEQ ID NO:42), for which the sequence(s) is/are given at the end of the application. The coding portion of transcript HUMF5A_PEA_1_T7 (SEQ ID NO:42) is shown in bold; this coding portion starts at position 183 and ends at position 1991. The transcript also has the following SNPs as listed in Table 329 (given according to their position on the nucleotide sequence, with the alternative nucleic acid listed; the last column indicates whether the SNP is known or not; the presence of known SNPs in variant protein HUMF5A_PEA_1_P8 (SEQ ID NO:366) sequence provides support for the deduced sequence of this variant protein according to the present invention).

TABLE 329

Nucleic acid SNPs

| SNP position on nucleotide sequence | Alternative nucleic acid | Previously known SNP? |
|---|---|---|
| 16 | C -> T | Yes |
| 225 | G -> A | Yes |
| 419 | A -> G | Yes |
| 501 | G -> C | Yes |
| 587 | G -> A | Yes |
| 734 | G -> T | Yes |
| 746 | G -> C | Yes |
| 951 | C -> T | Yes |
| 998 | C -> T | Yes |
| 1420 | T -> C | Yes |
| 1424 | A -> G | Yes |
| 1562 | C -> T | Yes |
| 1720 | G -> A | Yes |
| 1783 | G -> A | Yes |
| 1898 | G -> A | Yes |
| 2088 | G -> A | Yes |
| 2095 | G -> A | Yes |

As noted above, cluster HUMF5A features 33 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HUMF5A_PEA_1_node_0 (SEQ ID NO:238) according to the present invention is supported by 9 libraries. The number of libraries was determined as previously described. This segment can be found in the following transcript(s): HUMF5A_PEA_1_T1 (SEQ ID NO:40), HUMF5A_PEA_1_T3 (SEQ ID NO:41) and HUMF5A_PEA_1_T7 (SEQ ID NO.42). Table 330 below describes the starting and ending position of this segment on each transcript.

TABLE 330

Segment location on transcripts

| Transcript name | Segment starting position | Segment ending position |
|---|---|---|
| HUMF5A_PEA_1_T1 (SEQ ID NO:40) | 1 | 340 |
| HUMF5A_PEA_1_T3 (SEQ ID NO:41) | 1 | 340 |
| HUMF5A_PEA_1_T7 (SEQ ID NO:42) | 1 | 340 |

Segment cluster HUMF5A_PEA_1_node_4 (SEQ ID NO:239) according to the present invention is supported by 7 libraries. The number of libraries was determined as previously described. This segment can be found in the following transcript(s): HUMF5A_PEA_1_T1 (SEQ ID NO:40), HUMF5A_PEA_1_T3 (SEQ ID NO:41) and HUMF5A_PEA_1_T7 (SEQ ID NO:42). Table 331 below describes the starting and ending position of this segment on each transcript.

TABLE 331

Segment location on transcripts

| Transcript name | Segment starting position | Segment ending position |
|---|---|---|
| HUMF5A_PEA_1_T1 (SEQ ID NO:40) | 433 | 555 |
| HUMF5A_PEA_1_T3 (SEQ ID NO:41) | 433 | 555 |
| HUMF5A_PEA_1_T7 (SEQ ID NO:42) | 433 | 555 |

Segment cluster HUMF5A_PEA_1_node_6 (SEQ ID NO:240) according to the present invention is supported by 11 libraries. The number of libraries was determined as previously described. This segment can be found in the following transcript(s): HUMF5A_PEA_1_T1 (SEQ ID NO:40), HUMF5A_PEA_1_T3 (SEQ ID NO:41) and HUMF5A_PEA_1_T7 (SEQ ID NO:42). Table 332 below describes the starting and ending position of this segment on each transcript.

TABLE 332

Segment location on transcripts

| Transcript name | Segment starting position | Segment ending position |
|---|---|---|
| HUMF5A_PEA_1_T1 (SEQ ID NO:40) | 556 | 768 |
| HUMF5A_PEA_1_T3 (SEQ ID NO:41) | 556 | 768 |
| HUMF5A_PEA_1_T7 (SEQ ID NO:42) | 556 | 768 |

Segment cluster HUMF5A_PEA_1_node_8 (SEQ ID NO:241) according to the present invention is supported by 8 libraries. The number of libraries was determined as previously described. This segment can be found in the following transcript(s): HUMF5A_PEA_1_T1 (SEQ ID NO:40), HUMF5A_PEA_1_T3 (SEQ ID NO:41) and HUMF5A_PEA_1_T7 (SEQ ID NO:42). Table 333 below describes the starting and ending position of this segment on each transcript.

TABLE 333

Segment location on transcripts

| Transcript name | Segment starting position | Segment ending position |
|---|---|---|
| HUMF5A_PEA_1_T1 (SEQ ID NO:40) | 769 | 912 |
| HUMF5A_PEA_1_T3 (SEQ ID NO:41) | 769 | 912 |
| HUMF5A_PEA_1_T7 (SEQ ID NO:42) | 769 | 912 |

Segment cluster HUMF5A_PEA_1_node_10 (SEQ ID NO:242) according to the present invention is supported by 7 libraries. The number of libraries was determined as previously described. This segment can be found in the following transcript(s): HUMF5A_PEA_1_T1 (SEQ ID NO:40), HUMF5A_PEA_1_T3 (SEQ ID NO:41) and HUMF5A_PEA_1_T7 (SEQ ID NO:42). Table 334 below describes the starting and ending position of this segment on each transcript.

TABLE 334

Segment location on transcripts

| Transcript name | Segment starting position | Segment ending position |
|---|---|---|
| HUMF5A_PEA_1_T1 (SEQ ID NO:40) | 913 | 1134 |
| HUMF5A_PEA_1_T3 (SEQ ID NO:41) | 913 | 1134 |
| HUMF5A_PEA_1_T7 (SEQ ID NO:42) | 913 | 1134 |

Segment cluster HUMF5A_PEA_1_node_12 (SEQ ID NO:243) according to the present invention is supported by 10 libraries. The number of libraries was determined as previously described. This segment can be found in the following transcript(s): HUMF5A_PEA_1_T1 (SEQ ID NO:40), HUMF5A_PEA_1_T3 (SEQ ID NO:41) and HUMF5A_PEA_1_T7 (SEQ ID NO:42). Table 335 below describes the starting and ending position of this segment on each transcript.

TABLE 335

Segment location on transcripts

| Transcript name | Segment starting position | Segment ending position |
|---|---|---|
| HUMF5A_PEA_1_T1 (SEQ ID NO:40) | 1135 | 1300 |
| HUMF5A_PEA_1_T3 (SEQ ID NO:41) | 1135 | 1300 |
| HUMF5A_PEA_1_T7 (SEQ ID NO:42) | 1135 | 1300 |

Segment cluster HUMF5A_PEA_1_node_14 (SEQ ID NO:244) according to the present invention is supported by 9 libraries. The number of libraries was determined as previously described. This segment can be found in the following transcript(s): HUMF5A_PEA_1_T1 (SEQ ID NO:40), HUMF5A_PEA_1_T3 (SEQ ID NO:41) and HUMF5A_PEA_1_T7 (SEQ ID NO:42). Table 336 below describes the starting and ending position of this segment on each transcript.

TABLE 336

Segment location on transcripts

| Transcript name | Segment starting position | Segment ending position |
|---|---|---|
| HUMF5A_PEA_1_T1 (SEQ ID NO:40) | 1301 | 1478 |
| HUMF5A_PEA_1_T3 (SEQ ID NO:41) | 1301 | 1478 |
| HUMF5A_PEA_1_T7 (SEQ ID NO:42) | 1301 | 1478 |

Segment cluster HUMF5A_PEA_1_node_18 (SEQ ID NO:245) according to the present invention is supported by 10 libraries. The number of libraries was determined as previously described. This segment can be found in the following transcript(s): HUMF5A_PEA_1_T1 (SEQ ID NO:40), HUMF5A_PEA_1_T3 (SEQ ID NO:41) and HUMF5A_PEA_1_T7 (SEQ ID NO:42). Table 337 below describes the starting and ending position of this segment on each transcript.

TABLE 337

Segment location on transcripts

| Transcript name | Segment starting position | Segment ending position |
|---|---|---|
| HUMF5A_PEA_1_T1 (SEQ ID NO:40) | 1579 | 1793 |
| HUMF5A_PEA_1_T3 (SEQ ID NO:41) | 1579 | 1793 |
| HUMF5A_PEA_1_T7 (SEQ ID NO:42) | 1579 | 1793 |

Segment cluster HUMF5A_PEA_1_node_21 (SEQ ID NO:246) according to the present invention is supported by 12 libraries. The number of libraries was determined as previously described. This segment can be found in the following transcript(s): HUMF5A_PEA_1_T1 (SEQ ID NO:40), HUMF5A_PEA_1_T3 (SEQ ID NO:41) and HUMF5A_PEA_1_T7 (SEQ ID NO:42). Table 338 below describes the starting and ending position of this segment on each transcript.

TABLE 338

Segment location on transcripts

| Transcript name | Segment starting position | Segment ending position |
|---|---|---|
| HUMF5A_PEA_1_T1 (SEQ ID NO:40) | 1794 | 1944 |
| HUMF5A_PEA_1_T3 (SEQ ID NO:41) | 1794 | 1944 |
| HUMF5A_PEA_1_T7 (SEQ ID NO:42) | 1794 | 1944 |

Segment cluster HUMF5A_PEA_1_node_22 (SEQ ID NO:247 according to the present invention is supported by 1 libraries. The number of libraries was determined as previously described. This segment can be found in the following transcript(s): HUMF5A_PEA_1_T7 (SEQ ID NO:42). Table 339 below describes the starting and ending position of this segment on each transcript.

TABLE 339

Segment location on transcripts

| Transcript name | Segment starting position | Segment ending position |
|---|---|---|
| HUMF5A_PEA_1_T7 (SEQ ID NO:42) | 1945 | 2097 |

Segment cluster HUMF5A_PEA_1_node_24 (SEQ ID NO:248) according to the present invention is supported by 13 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 340 below describes the starting and ending position of this segment on each transcript.

TABLE 340

Segment location on transcripts

| Transcript name | Segment starting position | Segment ending position |
|---|---|---|
| HUMF5A_PEA_1_T1 (SEQ ID NO:40) | 1945 | 2157 |
| HUMF5A_PEA_1_T3 (SEQ ID NO:41) | 1945 | 2157 |

Segment cluster HUMF5A_PEA_1_node_26 (SEQ ID NO:249) according to the present invention is supported by 33 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 341 below describes the starting and ending position of this segment on each transcript.

TABLE 341

Segment location on transcripts

| Transcript name | Segment starting position | Segment ending position |
|---|---|---|
| HUMF5A_PEA_1_T1 (SEQ ID NO:40) | 2158 | 3766 |
| HUMF5A_PEA_1_T3 (SEQ ID NO:41) | 2158 | 3766 |

Segment cluster HUMF5A_PEA_1_node_27 (SEQ ID NO:250) according to the present invention is supported by 12 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 342 below describes the starting and ending position of this segment on each transcript.

TABLE 342

Segment location on transcripts

| Transcript name | Segment starting position | Segment ending position |
|---|---|---|
| HUMF5A_PEA_1_T1 (SEQ ID NO:40) | 3767 | 3936 |
| HUMF5A_PEA_1_T3 (SEQ ID NO:41) | 3767 | 3936 |

Segment cluster HUMF5A_PEA_1_node_29 (SEQ ID NO:251) according to the present invention is supported by 22 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 343 below describes the starting and ending position of this segment on each transcript.

TABLE 343

Segment location on transcripts

| Transcript name | Segment starting position | Segment ending position |
| --- | --- | --- |
| HUMF5A_PEA_1_T1 (SEQ ID NO:40) | 3937 | 4978 |
| HUMF5A_PEA_1_T3 (SEQ ID NO:41) | 3937 | 4978 |

Segment cluster HUMF5A_PEA_1_node_35 (SEQ ID NO:252) according to the present invention is supported by 7 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 344 below describes the starting and ending position of this segment on each transcript.

TABLE 344

Segment location on transcripts

| Transcript name | Segment starting position | Segment ending position |
| --- | --- | --- |
| HUMF5A_PEA_1_T1 (SEQ ID NO:40) | 5102 | 5338 |
| HUMF5A_PEA_1_T3 (SEQ ID NO:41) | 5154 | 5390 |

Segment cluster HUMF5A_PEA_1_node_37 (SEQ ID NO:253) according to the present invention is supported by 9 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 345 below describes the starting and ending position of this segment on each transcript.

TABLE 345

Segment location on transcripts

| Transcript name | Segment starting position | Segment ending position |
| --- | --- | --- |
| HUMF5A_PEA_1_T1 (SEQ ID NO:40) | 5339 | 5549 |
| HUMF5A_PEA_1_T3 (SEQ ID NO:41) | 5391 | 5601 |

Segment cluster HUMF5A_PEA_1_node_39 (SEQ ID NO:254) according to the present invention is supported by 10 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 346 below describes the starting and ending position of this segment on each transcript.

TABLE 346

Segment location on transcripts

| Transcript name | Segment starting positon | Segment ending position |
| --- | --- | --- |
| HUMF5A_PEA_1_T1 (SEQ ID NO:40) | 5550 | 5729 |
| HUMF5A_PEA_1_T3 (SEQ ID NO:41) | 5602 | 5781 |

Segment cluster HUMF5A_PEA_1_node_47 (SEQ ID NO:255) according to the present invention is supported by 14 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 347 below describes the starting and ending position of this segment on each transcript.

TABLE 347

Segment location on transcripts

| Transcript name | Segment starting position | Segment ending position |
| --- | --- | --- |
| HUMF5A_PEA_1_T1 (SEQ ID NO:40) | 6023 | 6178 |
| HUMF5A_PEA_1_T3 (SEQ ID NO:41) | 6075 | 6230 |

Segment cluster HUMF5A_PEA_1_node_50 (SEQ ID NO:256) according to the present invention is supported by 20 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 348 below describes the starting and ending position of this segment on each transcript.

TABLE 348

Segment location on transcripts

| Transcript name | Segment starting position | Segment ending position |
| --- | --- | --- |
| HUMF5A_PEA_1_T1 (SEQ ID NO:40) | 6179 | 6316 |
| HUMF5A_PEA_1_T3 (SEQ ID NO:41) | 6231 | 6368 |

Segment cluster HUMF5A_PEA_1_node_53 (SEQ ID NO:257) according to the present invention is supported by 29 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 349 below describes the starting and ending position of this segment on each transcript.

TABLE 349

Segment location on transcripts

| Transcript name | Segment starting position | Segment ending position |
| --- | --- | --- |
| HUMF5A_PEA_1_T1 (SEQ ID NO:40) | 6324 | 6475 |

TABLE 349-continued

Segment location on transcripts

| Transcript name | Segment starting position | Segment ending position |
| --- | --- | --- |
| HUMF5A_PEA_1_T3 (SEQ ID NO:41) | 6369 | 6520 |

Segment cluster HUMF5A_PEA_1_node_56 (SEQ ID NO:258) according to the present invention is supported by 24 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 350 below describes the starting and ending position of this segment on each transcript.

TABLE 350

Segment location on transcripts

| Transcript name | Segment starting position | Segment ending position |
| --- | --- | --- |
| HUMF5A_PEA_1_T1 (SEQ ID NO:40) | 6476 | 6611 |
| HUMF5A_PEA_1_T3 (SEQ ID NO:41) | 6521 | 6656 |

Segment cluster HUMF5A_PEA_1_node_60 (SEQ ID NO:259) according to the present invention is supported by 24 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 351 below describes the starting and ending position of this segment on each transcript.

TABLE 351

Segment location on transcripts

| Transcript name | Segment starting position | Segment ending position |
| --- | --- | --- |
| HUMF5A_PEA_1_T1 (SEQ ID NO:40) | 6666 | 6951 |
| HUMF5A_PEA_1_T3 (SEQ ID NO:41) | 6711 | 6996 |

According to an optional embodiment of the present invention, short segments related to the above cluster are also provided. These segments are up to about 120 bp in length, and so are included in a separate description.

Segment cluster HUMF5A_PEA_1_node_2 (SEQ ID NO:260) according to the present invention is supported by 6 libraries. The number of libraries was determined as previously described. This segment can be found in the following transcript(s): HUMF5A_PEA_1_T1 (SEQ ID NO:40), HUMF5A_PEA_1_T3 (SEQ ID NO:41) and HUMF5A_PEA_1_T7 (SEQ ID NO:42). Table 352 below describes the starting and ending position of this segment on each transcript.

TABLE 352

Segment location on transcripts

| Transcript name | Segment starting position | Segment ending position |
| --- | --- | --- |
| HUMF5A_PEA_1_T1 (SEQ ID NO:40) | 341 | 432 |
| HUMF5A_PEA_1_T3 (SEQ ID NO:41) | 341 | 432 |
| HUMF5A_PEA_1_T7 (SEQ ID NO:42) | 341 | 432 |

Segment cluster HUMF5A_PEA_1_node_16 (SEQ ID NO:261) according to the present invention is supported by 10 libraries. The number of libraries was determined as previously described. This segment can be found in the following transcript(s): HUMF5A_PEA_1_T1 (SEQ ID NO:40), HUMF5A_PEA_1_T3 (SEQ ID NO:41) and HUMF5A_PEA_1_T7 (SEQ ID NO:42). Table 353 below describes the starting and ending position of this segment on each transcript.

TABLE 353

Segment location on transcripts

| Transcript name | Segment starting position | Segment ending position |
| --- | --- | --- |
| HUMF5A_PEA_1_T1 (SEQ ID NO:40) | 1479 | 1578 |
| HUMF5A_PEA_1_T3 (SEQ ID NO:41) | 1479 | 1578 |
| HUMF5A_PEA_1_T7 (SEQ ID NO:42) | 1479 | 1578 |

Segment cluster HUMF5A_PEA_1_node_31 (SEQ ID NO:262) according to the present invention is supported by 3 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 354 below describes the starting and ending position of this segment on each transcript.

TABLE 354

Segment location on transcripts

| Transcript name | Segment starting position | Segment ending position |
| --- | --- | --- |
| HUMF5A_PEA_1_T1 (SEQ ID NO:40) | 4979 | 5033 |
| HUMF5A_PEA_1_T3 (SEQ ID NO:41) | 4979 | 5033 |

Segment cluster HUMF5A_PEA_1_node_32 (SEQ ID NO:263) according to the present invention is supported by 2 libraries. The number of libraries was determined as previously described. This segment can be found in the following transcript(s): HUMF5A_PEA_1_T3 (SEQ ID NO:41). Table 355 below describes the starting and ending position of this segment on each transcript.

TABLE 355

Segment location on transcripts

| Transcript name | Segment starting position | Segment ending position |
|---|---|---|
| HUMF5A_PEA_1_T3 (SEQ ID NO:41) | 5034 | 5085 |

Segment cluster HUMF5A_PEA_1_node_33 (SEQ ID NO:264) according to the present invention is supported by 4 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 356 below describes the starting and ending position of this segment on each transcript.

TABLE 356

Segment location on transcripts

| Transcript name | Segment starting position | Segment ending position |
|---|---|---|
| HUMF5A_PEA_1_T1 (SEQ ID NO:40) | 5034 | 5101 |
| HUMF5A_PEA_1_T3 (SEQ ID NO:41) | 5086 | 5153 |

Segment cluster HUMF5A_PEA_1_node_41 (SEQ ID NO:265) according to the present invention is supported by 8 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 357 below describes the starting and ending position of this segment on each transcript.

TABLE 357

Segment location on transcripts

| Transcript name | Segment starting position | Segment ending position |
|---|---|---|
| HUMF5A_PEA_1_T1 (SEQ ID NO:40) | 5730 | 5846 |
| HUMF5A_PEA_1_T3 (SEQ ID NO:41) | 5782 | 5898 |

Segment cluster HUMF5A_PEA_1_node_43 (SEQ ID NO:266) according to the present invention is supported by 6 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 358 below describes the starting and ending position of this segment on each transcript.

TABLE 358

Segment location on transcripts

| Transcript name | Segment starting position | Segment ending position |
|---|---|---|
| HUMF5A_PEA_1_T1 (SEQ ID NO:40) | 5847 | 5918 |
| HUMF5A_PEA_1_T3 (SEQ ID NO:41) | 5899 | 5970 |

Segment cluster HUMF5A_PEA_1_node_45 (SEQ ID NO:267) according to the present invention is supported by 12 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 359 below describes the starting and ending position of this segment on each transcript.

TABLE 359

Segment location on transcripts

| Transcript name | Segment starting position | Segment ending position |
|---|---|---|
| HUMF5A_PEA_1_T1 (SEQ ID NO:40) | 5919 | 6022 |
| HUMF5A_PEA_1_T3 (SEQ ID NO:41) | 5971 | 6074 |

Segment cluster HUMF5A_PEA_1_node_51 (SEQ ID NO:268) according to the present invention can be found in the following transcript(s): HUMF5A_PEA_1_T1 (SEQ ID NO:40). Table 360 below describes the starting and ending position of this segment on each transcript.

TABLE 360

Segment location on transcripts

| Transcript name | Segment starting position | Segment ending position |
|---|---|---|
| HUMF5A_PEA_1_T1 (SEQ ID NO:40) | 6317 | 6323 |

Segment cluster HUMF5A_PEA_1_node_57 (SEQ ID NO:269) according to the present invention is supported by 18 libraries. The number of libraries was determined as previously described. This segment can be found in the following transcript(s): HUMF5A_PEA_1_T1 (SEQ ID NO:40) and HUMF5A_PEA_1_T3 (SEQ ID NO:41). Table 361 below describes the starting and ending position of this segment on each transcript.

TABLE 361

Segment location on transcripts

| Transcript name | Segment starting position | Segment ending position |
|---|---|---|
| HUMF5A_PEA_1_T1 (SEQ ID NO:40) | 6612 | 6658 |
| HUMF5A_PEA_1_T3 (SEQ ID NO:41) | 6657 | 6703 |

Segment cluster HUMF5A_PEA_1_node_59 (SEQ ID NO:270) according to the present invention can be found in the following transcript(s): HUMF5A_PEA_1_T1 (SEQ ID NO:40) and HUMF5A_PEA_1_T3 (SEQ ID NO:41). Table 362 below describes the starting and ending position of this segment on each transcript.

TABLE 362

| Transcript name | Segment location on transcripts | |
|---|---|---|
| | Segment starting position | Segment ending position |
| HUMF5A_PEA_1_T1 (SEQ ID NO: 40) | 6659 | 6665 |

TABLE 362-continued

| Transcript name | Segment location on transcripts | |
|---|---|---|
| | Segment starting position | Segment ending position |
| HUMF5A_PEA_1_T3 (SEQ ID NO: 41) | 6704 | 6710 |

Variant Protein Alignment to the Previously Known Protein:

Sequence name: FA5_HUMAN_V1 (SEQ ID NO:393)
Sequence documentation:
Alignment of: HUMF5A_PEA_1_P3 (SEQ ID NO:364) × FA5_HUMAN_V1 (SEQ ID NO:393) . . .
Alignment segment 1/1:
Quality: 16060.00
Escore: 0
Matching length: 1617
Total length: 1617
Matching Percent Similarity: 100.00
Matching Percent Identity: 100.00
Total Percent Similarity: 100.00
Total Percent Identity: 100.00
Gaps: 0
Alignment:

```
  1  MFPGCPRLWVLVVLGTSWVGWGSQGTEAAQLRQFYVAAQGISWSYRPEPT   50
     ||||||||||||||||||||||||||||||||||||||||||||||||||
  1  MFPGCPRLWVLVVLGTSWVGWGSQGTEAAQLRQFYVAAQGISWSYRPEPT   50

51  NSSLNLSVTSFKKIVYREYEPYFKKEKPQSTISGLLGPTLYAEVGDIIKV  100
     ||||||||||||||||||||||||||||||||||||||||||||||||||
 51  NSSLNLSVTSFKKIVYREYEPYFKKEKPQSTISGLLGPTLYAEVGDIIKV  100

101  HFKNKADKPLSIHPQGIRYSKLSEGASYLDHTFPAEKMDDAVAPGREYTY  150
     ||||||||||||||||||||||||||||||||||||||||||||||||||
101  HFKNKADKPLSIHPQGIRYSKLSEGASYLDHTFPAEKMDDAVAPGREYTY  150

151  EWSISEDSGPTHDDPPCLTHIYYSHENLIEDFNSGLIGPLLICKKGTLTE  200
     ||||||||||||||||||||||||||||||||||||||||||||||||||
151  EWSISEDSGPTHDDPPCLTHIYYSHENLIEDFNSGLIGPLLICKKGTLTE  200

201  GGTQKTFDKQIVLLFAVFDESKSWSQSSSLMYTVNGYVNGTMPDITVCAH  250
     ||||||||||||||||||||||||||||||||||||||||||||||||||
201  GGTQKTFDKQIVLLFAVFDESKSWSQSSSLMYTVNGYVNGTMPDITVCAH  250

251  DHISWHLLGMSSGPELFSIHFNGQVLEQNHHKVSAITLVSATSTTANMTV  300
     ||||||||||||||||||||||||||||||||||||||||||||||||||
251  DHISWHLLGMSSGPELFSIHFNGQVLEQNHHKVSAITLVSATSTTANMTV  300

301  GPEGKWIISSLTPKHLQAGMQAYIDIKNCPKKTRNLKKITREQRRHMKRW  350
     ||||||||||||||||||||||||||||||||||||||||||||||||||
301  GPEGKWIISSLTPKHLQAGMQAYIDIKNCPKKTRNLKKITREQRRHMKRW  350

351  EYFIAAEEVIWDYAPVIPANMDKKYRSQHLDNFSNQIGKHYKKVMYTQYE  400
     ||||||||||||||||||||||||||||||||||||||||||||||||||
351  EYFIAAEEVIWDYAPVIPANMDKKYRSQHLDNFSNQIGKHYKKVMYTQYE  400

401  DESFTKHTVNPNMKEDGILGPIIRAQVRDTLKIVFKNMASRPYSIYPHGV  450
     ||||||||||||||||||||||||||||||||||||||||||||||||||
401  DESFTKHTVNPNMKEDGILGPIIRAQVRDTLKIVFKNMASRPYSIYPHGV  450
```

```
451  TFSPYEDEVNSSFTSGRNNTMIRAVQPGETYTYKWNILEFDEPTENDAQC  500
     ||||||||||||||||||||||||||||||||||||||||||||||||||
451  TFSPYEDEVNSSFTSGRNNTMIRAVQPGETYTYKWNILEFDEPTENDAQC  500

501  LTRPYYSDVDIMRDIASGLIGLLLICKSRSLDRRGIQRAADIEQQAVFAV  550
     ||||||||||||||||||||||||||||||||||||||||||||||||||
501  LTRPYYSDVDIMRDIASGLIGLLLICKSRSLDRRGIQRAADIEQQAVFAV  550

551  FDENKSWYLEDNINKFCENPDEVKRDDPKFYESNIMSTINGYVPESITTL  600
     ||||||||||||||||||||||||||||||||||||||||||||||||||
551  FDENKSWYLEDNINKFCENPDEVKRDDPKFYESNIMSTINGYVPESITTL  600

601  GFCFDDTVQWHFCSVGTQNEILTIHFTGHSFIYGKRHEDTLTLFPMRGES  650
     ||||||||||||||||||||||||||||||||||||||||||||||||||
601  GFCFDDTVQWHFCSVGTQNEILTIHFTGHSFIYGKRHEDTLTLFPMRGES  650

651  VTVTMDNVGTWMLTSMNSSPRSKKLRLKFRDVKCIPDDDEDSYEIFEPPE  700
     ||||||||||||||||||||||||||||||||||||||||||||||||||
651  VTVTMDNVGTWMLTSMNSSPRSKKLRLKFRDVKCIPDDDEDSYEIFEPPE  700

701  STVMATRKMHDRLEPEDEESDADYDYQNRLAAALGIRSFRNSSLNQEEEE  750
     ||||||||||||||||||||||||||||||||||||||||||||||||||
701  STVMATRKMHDRLEPEDEESDADYDYQNRLAAALGIRSFRNSSLNQEEEE  750

751  FNLTALALENGTEFVSSNTDIIVGSNYSSPSNISKFTVNNLAEPQKAPSH  800
     ||||||||||||||||||||||||||||||||||||||||||||||||||
751  FNLTALALENGTEFVSSNTDIIVGSNYSSPSNISKFTVNNLAEPQKAPSH  800

801  QQATTAGSPLRHLIGKNSVLNSSTAEHSSPYSEDPIEDPLQPDVTGIRLL  850
     ||||||||||||||||||||||||||||||||||||||||||||||||||
801  QQATTAGSPLRHLIGKNSVLNSSTAEHSSPYSEDPIEDPLQPDVTGIRLL  850

851  SLGAGEFRSQEHAKRKGPKVERDQAAKHRFSWMKLLAHKVGRHLSQDTGS  900
     ||||||||||||||||||||||||||||||||||||||||||||||||||
851  SLGAGEFRSQEHAKRKGPKVERDQAAKHRFSWMKLLAHKVGRHLSQDTGS  900

901  PSGMRPWEDLPSQDTGSPSRMRPWKDPPSDLLLLKQSNSSKILVGRWHLA  950
     ||||||||||||||||||||||||||||||||||||||||||||||||||
901  PSGMRPWEDLPSQDTGSPSRMRPWKDPPSDLLLLKQSNSSKILVGRWHLA  950

951  SEKGSYEIIQDTDEDTAVNNWLISPQNASRAWGESTPLANKPGKQSGHPK  1000
     ||||||||||||||||||||||||||||||||||||||||||||||||||
951  SEKGSYEIIQDTDEDTAVNNWLISPQNASRAWGESTPLANKPGKQSGHPK  1000

1001 FPRVRHKSLQVRQDGGKSRLKKSQFLIKTRKKKKEKHTHHAPLSPRTFHP  1050
     ||||||||||||||||||||||||||||||||||||||||||||||||||
1001 FPRVRHKSLQVRQDGGKSRLKKSQFLIKTRKKKKEKHTHHAPLSPRTFHP  1050

1051 LRSEAYNTFSERRLKHSLVLHKSNETSLPTDLNQTLPSMDFGWIASLPDH  1100
     ||||||||||||||||||||||||||||||||||||||||||||||||||
1051 LRSEAYNTFSERRLKHSLVLHKSNETSLPTDLNQTLPSMDFGWIASLPDH  1100

1101 NQNSSNDTGQASCPPGLYQTVPPEEHYQTFPIQDPDQMHSTSDPSHRSSS  1150
     ||||||||||||||||||||||||||||||||||||||||||||||||||
1101 NQNSSNDTGQASCPPGLYQTVPPEEHYQTFPIQDPDQMHSTSDPSHRSSS  1150

1151 PELSEMLEYDRSHKSFPTDISQMSPSSEHEVWQTVISPDLSQVTLSPELS  1200
     ||||||||||||||||||||||||||||||||||||||||||||||||||
1151 PELSEMLEYDRSHKSFPTDISQMSPSSEHEVWQTVISPDLSQVTLSPELS  1200

1201 QTNLSPDLSHTTLSPELIQRNLSPALGQMPISPDLSHTTLSPDLSHTTLS  1250
     ||||||||||||||||||||||||||||||||||||||||||||||||||
1201 QTNLSPDLSHTTLSPELIQRNLSPALGQMPISPDLSHTTLSPDLSHTTLS  1250
```

```
1251  LDLSQTNLSPELSQTNLSPALGQMPLSPDLSHTTLSLDFSQTNLSPELSH  1300
      ||||||||||||||||||||||||||||||||||||||||||||||||||
1251  LDLSQTNLSPELSQTNLSPALGQMPLSPDLSHTTLSLDFSQTNLSPELSH  1300

1301  MTLSPELSQTNLSPALGQMPISPDLSHTTLSLDFSQTNLSPELSQTNLSP  1350
      ||||||||||||||||||||||||||||||||||||||||||||||||||
1301  MTLSPELSQTNLSPALGQMPISPDLSHTTLSLDFSQTNLSPELSQTNLSP  1350

1351  ALGQMPLSPDPSHTTLSLDLSQTNLSPELSQTNLSPDLSEMPLFADLSQI  1400
      ||||||||||||||||||||||||||||||||||||||||||||||||||
1351  ALGQMPLSPDPSHTTLSLDLSQTNLSPELSQTNLSPDLSEMPLFADLSQI  1400

1401  PLTPDLDQMTLSPDLGETDLSPNFGQMSLSPDLSQVTLSPDISDTTLLPD  1450
      ||||||||||||||||||||||||||||||||||||||||||||||||||
1401  PLTPDLDQMTLSPDLGETDLSPNFGQMSLSPDLSQVTLSPDISDTTLLPD  1450

1451  LSQISPPPDLDQIFYPSESSQSLLLQEFNESFPYPDLGQMPSPSSPTLND  1500
      ||||||||||||||||||||||||||||||||||||||||||||||||||
1451  LSQISPPPDLDQIFYPSESSQSLLLQEFNESFPYPDLGQMPSPSSPTLND  1500

1501  TFLSKEFNPLVIVGLSKDGTDYIEIIPKEEVQSSEDDYAEIDYVPYDDPY  1550
      ||||||||||||||||||||||||||||||||||||||||||||||||||
1501  TFLSKEFNPLVIVGLSKDGTDYIEIIPKEEVQSSEDDYAEIDYVPYDDPY  1550

1551  KTDVRTNINSSRDPDNIAAWYLRSNNGNRRNYYIAAEEISWDYSEFVQRE  1600
      ||||||||||||||||||||||||||||||||||||||||||||||||||
1551  KTDVRTNINSSRDPDNIAAWYLRSNNGNRRNYYIAAEEISWDYSEFVQRE  1600

1601  TDIEDSDDIPEDTTYKK                                  1617
      |||||||||||||||||
1601  TDIEDSDDIPEDTTYKK                                  1617
```

Sequence name: FA5_HUMAN_V1 (SEQ ID NO:393)
Sequence documentation:
Alignment of: HUMF5A_PEA_1_P4 (SEQ ID NO:365) × FA5_HUMAN_V1 (SEQ ID NO:393) . . .
Alignment segment 1/1:
Quality: 20532.00
Escore: 0
Matching length: 2062
Total length: 2062
Matching Percent Similarity: 100.00
Matching Percent Identity: 100.00
Total Percent Similarity: 100.00
Total Percent Identity: 100.00
Gaps: 0
Alignment:

```
  1  MFPGCPRLWVLVVLGTSWVGWGSQGTEAAQLRQFYVAAQGISWSYRPEPT   50
     ||||||||||||||||||||||||||||||||||||||||||||||||||
  1  MFPGCPRLWVLVVLGTSWVGWGSQGTEAAQLRQFYVAAQGISWSYRPEPT   50

51  NSSLNLSVTSFKKIVYREYEPYFKKEKPQSTISGLLGPTLYAEVGDIIKV  100
     ||||||||||||||||||||||||||||||||||||||||||||||||||
 51  NSSLNLSVTSFKKIVYREYEPYFKKEKPQSTISGLLGPTLYAEVGDIIKV  100

101  HFKNKADKPLSIHPQGIRYSKLSEGASYLDHTFPAEKMDDAVAPGREYTY  150
     ||||||||||||||||||||||||||||||||||||||||||||||||||
101  HFKNKADKPLSIHPQGIRYSKLSEGASYLDHTFPAEKMDDAVAPGREYTY  150

151  EWSISEDSGPTHDDPPCLTHIYYSHENLIEDFNSGLIGPLLICKKGTLTE  200
     ||||||||||||||||||||||||||||||||||||||||||||||||||
151  EWSISEDSGPTHDDPPCLTHIYYSHENLIEDFNSGLIGPLLICKKGTLTE  200
```

```
-continued

201 GGTQKTFDKQIVLLFAVFDESKSWSQSSSLMYTVNGYVNGTMPDITVCAH 250
    ||||||||||||||||||||||||||||||||||||||||||||||||||
201 GGTQKTFDKQIVLLFAVFDESKSWSQSSSLMYTVNGYVNGTMPDITVCAH 250

251 DHISWHLLGMSSGPELFSIHFNGQVLEQNHHKVSAITLVSATSTTANMTV 300
    ||||||||||||||||||||||||||||||||||||||||||||||||||
251 DHISWHLLGMSSGPELFSIHFNGQVLEQNHHKVSAITLVSATSTTANMTV 300

301 GPEGKWIISSLTPKHLQAGMQAYIDIKNCPKKTRNLKKITREQRRHMKRW 350
    ||||||||||||||||||||||||||||||||||||||||||||||||||
301 GPEGKWIISSLTPKHLQAGMQAYIDIKNCPKKTRNLKKITREQRRHMKRW 350

351 EYFIAAEEVIWDYAPVIPANMDKKYRSQHLDNFSNQIGKHYKKVMYTQYE 400
    ||||||||||||||||||||||||||||||||||||||||||||||||||
351 EYFIAAEEVIWDYAPVIPANMDKKYRSQHLDNFSNQIGKHYKKVMYTQYE 400

401 DESFTKHTVNPNMKEDGILGPIIRAQVRDTLKIVFKNMASRPYSIYPHGV 450
    ||||||||||||||||||||||||||||||||||||||||||||||||||
401 DESFTKHTVNPNMKEDGILGPIIRAQVRDTLKIVFKNMASRPYSIYPHGV 450

451 TFSPYEDEVNSSFTSGRNNTMIRAVQPGETYTYKWNILEFDEPTENDAQC 500
    ||||||||||||||||||||||||||||||||||||||||||||||||||
451 TFSPYEDEVNSSFTSGRNNTMIRAVQPGETYTYKWNILEFDEPTENDAQC 500

501 LTRPYYSDVDIMRDIASGLIGLLLICKSRSLDRRGIQRAADIEQQAVFAV 550
    ||||||||||||||||||||||||||||||||||||||||||||||||||
501 LTRPYYSDVDIMRDIASGLIGLLLICKSRSLDRRGIQRAADIEQQAVFAV 550

551 FDENKSWYLEDNINKFCENPDEVKRDDPKFYESNIMSTINGYVPESITTL 600
    ||||||||||||||||||||||||||||||||||||||||||||||||||
551 FDENKSWYLEDNINKFCENPDEVKRDDPKFYESNIMSTINGYVPESITTL 600

601 GFCFDDTVQWHFCSVGTQNEILTIHFTGHSFIYGKRHEDTLTLFPMRGES 650
    ||||||||||||||||||||||||||||||||||||||||||||||||||
601 GFCFDDTVQWHFCSVGTQNEILTIHFTGHSFIYGKRHEDTLTLFPMRGES 650

651 VTVTMDNVGTWMLTSMNSSPRSKKLRLKFRDVKCIPDDDEDSYEIFEPPE 700
    ||||||||||||||||||||||||||||||||||||||||||||||||||
651 VTVTMDNVGTWMLTSMNSSPRSKKLRLKFRDVKCIPDDDEDSYEIFEPPE 700

701 STVMATRKMHDRLEPEDEESDADYDYQNRLAAALGIRSFRNSSLNQEEEE 750
    ||||||||||||||||||||||||||||||||||||||||||||||||||
701 STVMATRKMHDRLEPEDEESDADYDYQNRLAAALGIRSFRNSSLNQEEEE 750

751 FNLTALALENGTEFVSSNTDIIVGSNYSSPSNISKFTVNNLAEPQKAPSH 800
    ||||||||||||||||||||||||||||||||||||||||||||||||||
751 FNLTALALENGTEFVSSNTDIIVGSNYSSPSNISKFTVNNLAEPQKAPSH 800

801 QQATTAGSPLRHLIGKNSVLNSSTAEHSSPYSEDPIEDPLQPDVTGIRLL 850
    ||||||||||||||||||||||||||||||||||||||||||||||||||
801 QQATTAGSPLRHLIGKNSVLNSSTAEHSSPYSEDPIEDPLQPDVTGIRLL 850

851 SLGAGEFRSQEHAKRKGPKVERDQAAKHRFSWMKLLAHKVGRHLSQDTGS 900
    ||||||||||||||||||||||||||||||||||||||||||||||||||
851 SLGAGEFRSQEHAKRKGPKVERDQAAKHRFSWMKLLAHKVGRHLSQDTGS 900

901 PSGMRPWEDLPSQDTGSPSRMRPWKDPPSDLLLLKQSNSSKILVGRWHLA 950
    ||||||||||||||||||||||||||||||||||||||||||||||||||
901 PSGMRPWEDLPSQDTGSPSRMRPWKDPPSDLLLLKQSNSSKILVGRWHLA 950

951 SEKGSYEIIQDTDEDTAVNNWLISPQNASRAWGESTPLANKPGKQSGHPK 1000
    ||||||||||||||||||||||||||||||||||||||||||||||||||
951 SEKGSYEIIQDTDEDTAVNNWLISPQNASRAWGESTPLANKPGKQSGHPK 1000
```

```
1001  FPRVRHKSLQVRQDGGKSRLKKSQFLIKTRKKKKEKHTHHAPLSPRTFHP  1050
      |||||||||||||||||||||||||||||||||||||||||||||||||
1001  FPRVRHKSLQVRQDGGKSRLKKSQFLIKTRKKKKEKHTHHAPLSPRTFHP  1050

1051  LRSEAYNTFSERRLKHSLVLHKSNETSLPTDLNQTLPSMDFGWIASLPDH  1100
      ||||||||||||||||||||||||||| |||||||||||||||||||||
1051  LRSEAYNTFSERRLKHSLVLHKSNETLLPTDLNQTLPSMDFGWIASLPDH  1100

1101  NQNSSNDTGQASCPPGLYQTVPPEEHYQTFPIQDPDQMHSTSDPSHRSSS  1150
      |||||||||||||||||||||||||||||||||||||||||||||||||
1101  NQNSSNDTGQASCPPGLYQTVPPEEHYQTFPIQDPDQMHSTSDPSHRSSS  1150

1151  PELSEMLEYDRSHKSFPTDISQMSPSSEHEVWQTVISPDLSQVTLSPELS  1200
      |||||||||||||||||||||||||||||||||||||||||||||||||
1151  PELSEMLEYDRSHKSFPTDISQMSPSSEHEVWQTVISPDLSQVTLSPELS  1200

1201  QTNLSPDLSHTTLSPELIQRNLSPALGQMPISPDLSHTTLSPDLSHTTLS  1250
      |||||||||||||||||||||||||||||||||||||||||||||||||
1201  QTNLSPDLSHTTLSPELIQRNLSPALGQMPISPDLSHTTLSPDLSHTTLS  1250

1251  LDLSQTNLSPELSQTNLSPALGQMPLSPDLSHTTLSLDFSQTNLSPELSH  1300
      |||||||||||||||||||||||||||||||||||||||||||||||||
1251  LDLSQTNLSPELSQTNLSPALGQMPLSPDLSHTTLSLDFSQTNLSPELSH  1300

1301  MTLSPELSQTNLSPALGQMPISPDLSHTTLSLDFSQTNLSPELSQTNLSP  1350
      |||||||||||||||||||||||||||||||||||||||||||||||||
1301  MTLSPELSQTNLSPALGQMPISPDLSHTTLSLDFSQTNLSPELSQTNLSP  1350

1351  ALGQMPLSPDPSHTTLSLDLSQTNLSPELSQTNLSPDLSEMPLFADLSQI  1400
      |||||||||||||||||||||||||||||||||||||||||||||||||
1351  ALGQMPLSPDPSHTTLSLDLSQTNLSPELSQTNLSPDLSEMPLFADLSQI  1400

1401  PLTPDLDQMTLSPDLGETDLSPNFGQMSLSPDLSQVTLSPDISDTTLLPD  1450
      |||||||||||||||||||||||||||||||||||||||||||||||||
1401  PLTPDLDQMTLSPDLGETDLSPNFGQMSLSPDLSQVTLSPDISDTTLLPD  1450

1451  LSQISPPPDLDQIFYPSESSQSLLLQEFNESFPYPDLGQMPSPSSPTLND  1500
      |||||||||||||||||||||||||||||||||||||||||||||||||
1451  LSQISPPPDLDQIFYPSESSQSLLLQEFNESFPYPDLGQMPSPSSPTLND  1500

1501  TFLSKEFNPLVIVGLSKDGTDYIEIIPKEEVQSSEDDYAEIDYVPYDDPY  1550
      |||||||||||||||||||||||||||||||||||||||||||||||||
1501  TFLSKEFNPLVIVGLSKDGTDYIEIIPKEEVQSSEDDYAEIDYVPYDDPY  1550

1551  KTDVRTNINSSRDPDNIAAWYLRSNNGNRRNYYIAAEEISWDYSEFVQRE  1600
      |||||||||||||||||||||||||||||||||||||||||||||||||
1551  KTDVRTNINSSRDPDNIAAWYLRSNNGNRRNYYIAAEEISWDYSEFVQRE  1600

1601  TDIEDSDDIPEDTTYKKVVFRKYLDSTFTKRDPRGEYEEHLGILGPIIRA  1650
      |||||||||||||||||||||||||||||||||||||||||||||||||
1601  TDIEDSDDIPEDTTYKKVVFRKYLDSTFTKRDPRGEYEEHLGILGPIIRA  1650

1651  EVDDVIQVRFKNLASRPYSLHAHGLSYEKSSEGKTYEDDSPEWFKEDNAV  1700
      |||||||||||||||||||||||||||||||||||||||||||||||||
1651  EVDDVIQVRFKNLASRPYSLHAHGLSYEKSSEGKTYEDDSPEWFKEDNAV  1700

1701  QPNSSYTYVWHATERSGPESPGSACRAWAYYSAVNPEKDIHSGLIGPLLI  1750
      |||||||||||||||||||||||||||||||||||||||||||||||||
1701  QPNSSYTYVWHATERSGPESPGSACRAWAYYSAVNPEKDIHSGLIGPLLI  1750

1751  CQKGILHKDSNMPVDMREFVLLFMTFDEKKSWYYEKKSRSSWRLTSSEMK  1800
      |||||||||||||||||||||||||||||||||||||||||||||||||
1751  CQKGILHKDSNMPVDMREFVLLFMTFDEKKSWYYEKKSRSSWRLTSSEMK  1800
```

```
1801  KSHEFHAINGMIYSLPGLKMYEQEWVRLHLLNIGGSQDIHVVHFHGQTLL  1850
      ||||||||||||||||||||||||||||||||||||||||||||||||||
1801  KSHEFHAINGMIYSLPGLKMYEQEWVRLHLLNIGGSQDIHVVHFHGQTLL  1850

1851  ENGNKQHQLGVWPLLPGSFKTLEMKASKPGWWLLNTEVGENQRAGMQTPF  1900
      ||||||||||||||||||||||||||||||||||||||||||||||||||
1851  ENGNKQHQLGVWPLLPGSFKTLEMKASKPGWWLLNTEVGENQRAGMQTPF  1900

1901  LIMDRDCRMPMGLSTGIISDSQIKASEFLGYWEPRLARLNNGGSYNAWSV  1950
      ||||||||||||||||||||||||||||||||||||||||||||||||||
1901  LIMDRDCRMPMGLSTGIISDSQIKASEFLGYWEPRLARLNNGGSYNAWSV  1950

1951  EKLAAEFASKPWIQVDMQKEVIITGIQTQGAKHYLKSCYTTEFYVAYSSN  2000
      ||||||||||||||||||||||||||||||||||||||||||||||||||
1951  EKLAAEFASKPWIQVDMQKEVIITGIQTQGAKHYLKSCYTTEFYVAYSSN  2000

2001  QINWQIFKGNSTRNVMYFNGNSDASTIKENQFDPPIVARYIRISPTRAYN  2050
      ||||||||||||||||||||||||||||||||||||||||||||||||||
2001  QINWQIFKGNSTRNVMYFNGNSDASTIKENQFDPPIVARYIRISPTRAYN  2050

2051  RPTLRLELQGCE  2062
      ||||||||||||
2051  RPTLRLELQGCE  2062
```

Sequence name: FA5_HUMAN
Sequence documentation:
Alignment of: HUMF5A_PEA_1_P8 (SEQ ID NO:366) × FA5_HUMAN . . .
Alignment segment 1/1:
Quality: 5863.00
Escore: 0
Matching length: 588
Total length: 588
Matching Percent Similarity: 100.00
Matching Percent Identity: 99.83
Total Percent Similarity: 100
Total Percent Identity: 99.83
Gaps: 0
Alignment:

```
   1  MFPGCPRLWVLVVLGTSWVGWGSQGTEAAQLRQFYVAAQGISWSYRPEPT   50
      ||||||||||||||||||||||||||||||||||||||||||||||||||
   1  MFPGCPRLWVLVVLGTSWVGWGSQGTEAAQLRQFYVAAQGISWSYRPEPT   50

51  NSSLNLSVTSFKKIVYREYEPYFKKEKPQSTISGLLGPTLYAEVGDIIKV  100
      ||||||||||||||||||||||||||||||||||||||||||||||||||
  51  NSSLNLSVTSFKKIVYREYEPYFKKEKPQSTISGLLGPTLYAEVGDIIKV  100

101  HFKNKADKPLSIHPQGIRYSKLSEGASYLDHTFPAEKMDDAVAPGREYTY  150
      ||||||||||||||||||||||||||||||||||||||||||||||||||
 101  HFKNKADKPLSIHPQGIRYSKLSEGASYLDHTFPAEKMDDAVAPGREYTY  150

151  EWSISEDSGPTHDDPPCLTHIYYSHENLIEDFNSGLIGPLLICKKGTLTE  200
      ||||||||||||||||||||||||||||||||||||||||||||||||||
 151  EWSISEDSGPTHDDPPCLTHIYYSHENLIEDFNSGLIGPLLICKKGTLTE  200

201  GGTQKTFDKQIVLLFAVFDESKSWSQSSSLMYTVNGYVNGTMPDITVCAH  250
      ||||||||||||||||||||||||||||||||||||||||||||||||||
 201  GGTQKTFDKQIVLLFAVFDESKSWSQSSSLMYTVNGYVNGTMPDITVCAH  250

251  DHISWHLLGMSSGPELFSIHFNGQVLEQNHHKVSAITLVSATSTTANMTV  300
      ||||||||||||||||||||||||||||||||||||||||||||||||||
 251  DHISWHLLGMSSGPELFSIHFNGQVLEQNHHKVSAITLVSATSTTANMTV  300

301  GPEGKWIISSLTPKHLQAGMQAYIDIKNCPKKTRNLKKITREQRRHMKRW  350
      ||||||||||||||||||||||||||||||||||||||||||||||||||
 301  GPEGKWIISSLTPKHLQAGMQAYIDIKNCPKKTRNLKKITREQRRHMKRW  350
```

```
351 EYFIAAEEVIWDYAPVIPANMDKKYRSQHLDNFSNQIGKHYKKVMYTQYE 400
    |||||||||||||||||||||||||||||||||||||||||||||||||
351 EYFIAAEEVIWDYAPVIPANMDKKYRSQHLDNFSNQIGKHYKKVMYTQYE 400

401 DESFTKHTVNPNMKEDGILGPIIRAQVRDTLKIVFKNMASRPYSIYPHGV 450
    |||||||||||||||||||||||||||||||||||||||||||||||||
401 DESFTKHTVNPNMKEDGILGPIIRAQVRDTLKIVFKNMASRPYSIYPHGV 450

451 TFSPYEDEVNSSFTSGRNNTMIRAVQPGETYTYKWNILEFDEPTENDAQC 500
    |||||||||||||||||||||||||||||||||||||||||||||||||
451 TFSPYEDEVNSSFTSGRNNTMIRAVQPGETYTYKWNILEFDEPTENDAQC 500

501 LTRPYYSDVDIMRDIASGLIGLLLICKSRSLDRRGIQRAADIEQQAVFAV 550
    |||||||||||||||||||||||||||||||||||||||||||||||||
501 LTRPYYSDVDIMRDIASGLIGLLLICKSRSLDRRGIQRAADIEQQAVFAV 550

551 FDENKSWYLEDNINKFCENPDEVKRDDPKFYESNIMSS               588
    |||||||||||||||||||||||||||||||||||||:
551 FDENKSWYLEDNINKFCENPDEVKRDDPKFYESNIMST               588
```

Description for Cluster Z40511

Cluster Z40511 features 1 transcript(s) and 14 segment(s) of interest, the names for which are given in Tables 363 and 364, respectively, the sequences themselves are given at the end of the application. The selected protein variants are given in table 365.

TABLE 363

Transcripts of interest

| Transcript Name | Sequence ID No. |
| --- | --- |
| Z40511_T8 | 43 |

TABLE 364

Segments of interest

| Segment Name | Sequence ID No. |
| --- | --- |
| Z40511_node_4 | 271 |
| Z40511_node_10 | 272 |
| Z40511_node_11 | 273 |
| Z40511_node_15 | 274 |
| Z40511_node_17 | 275 |
| Z40511_node_18 | 276 |
| Z40511_node_19 | 277 |
| Z40511_node_20 | 278 |
| Z40511_node_21 | 279 |
| Z40511_node_23 | 280 |
| Z40511_node_25 | 281 |
| Z40511_node_16 | 282 |
| Z40511_node_22 | 283 |
| Z40511_node_24 | 284 |

TABLE 365

Proteins of interest

| Protein Name | Sequence ID No. | Corresponding Transcript(s) |
| --- | --- | --- |
| Z40511_P5 | 367 | Z40511_T8 (SEQ ID NO:43) |

These sequences are variants of the known protein Hypothetical protein (SwissProt accession identifier Q96DV8), SEQ ID NO:394, referred to herein as the previously known protein.

The sequence for protein Hypothetical protein is given at the end of the application, as "Hypothetical protein amino acid sequence".

As noted above, cluster Z40511 features 1 transcript(s), which were listed in Table 363 above. These transcript(s) encode for protein(s) which are variant(s) of protein Hypothetical protein. A description of each variant protein according to the present invention is now provided.

Variant protein Z40511_P5 (SEQ ID NO:367) according to the present invention has an amino acid sequence as given at the end of the application; it is encoded by transcript(s) Z40511_T8 (SEQ ID NO:43). An alignment is given to the known protein (Hypothetical protein) at the end of the application. One or more alignments to one or more previously published protein sequences are given at the end of the application. A brief description of the relationship of the variant protein according to the present invention to each such aligned protein is as follows:

Comparison report between Z40511_P5 (SEQ ID NO:367) and Q9Y4S1_V2_SEQ ID NO: 396:

1. An isolated chimeric polypeptide encoding for Z40511_P5 (SEQ ID NO:367) comprising a first amino acid sequence being at least 90% homologous to MVYKTLFAL-CILTAGWRVQSLPTSAPLSVSLPT-NIVPPTTIWTSSPQNTDADTASPSNGT HNNSV-LPVTASAPTSLLPKNISIESREEEITSPGSNWEGTNTDP SPSGFSSTSGGVHLTTTL EEHSSGT-PEAGVAATLSQSAAEPPTLISPQA-PASSPSSLSTSPPEVFSASVTTNHSSTVTST QPT-GAPTAPESPTEESSSDHTPTSHATAEPVPQEKTPPTT VSGKVMCELIDMET corresponding to amino acids 1-238 of Q9Y4S1_V2 (SEQ ID NO:396), which also corresponds to amino acids 1-238 of Z40511_P5 (SEQ ID NO:367), and a second amino acid sequence being at least 70%, optionally at least 80%, preferably at least 85%, more preferably at least 90% and most preferably at least 95% homologous to a polypeptide having the sequence TTTFPRVIMQEVE-HALSSGIPPMEDFWTTMTTGPGETTT-TLCTMTPNNGIWPGMRINCS LFISAYPVELIST (SEQ ID NO: 572) corresponding to amino acids 239-310 of Z40511_P5 (SEQ ID NO:367), wherein said first amino acid sequence and second amino acid sequence are contiguous and in a sequential order.

2. An isolated polypeptide encoding for a tail of Z40511_P5 (SEQ ID NO:367) comprising a polypeptide being at least 70%, optionally at least about 80%, preferably at least about 85%, more preferably at least about 90% and most preferably at least about 95% homologous to the sequence TTTFPRVIMQEVEHALSSGIPPMEDFWTTMTTGPGETTTTLCTMTPNNGIWPGMRINCSLFISAYPVELIST (SEQ ID NO: 572) in Z40511_P5 (SEQ ID NO:367).

Comparison report between Z40511_P5 (SEQ ID NO:367) and Q96DV8_V1 (SEQ ID NO:395) (SEQ ID NO: 395):

1. An isolated chimeric polypeptide encoding for Z40511_P5 (SEQ ID NO:367) comprising a first amino acid sequence being at least 90% homologous to MVYKTLFALCILTAGWRVQSLPTSAPLSVSLPTNIVPPTTIWTSSPQNTDADTASPSNGT HNNSVLPVTASAPTSLLPKNISIESREEEITSPGSNWEGTNTD PSPSGFSSTSGGVHLTTTL EEHSSGTPEAGVAATLSQSAAEPPTLISPQAPASSPSSLSTSPPEVFSASVTTNHSSTVTST QPTGAPTAPESPTEESSSDHTPTSHATAEPVPQEKTPPTT VSGKVMCELIDMETTTTFPR VIMQEVEHALSSG corresponding to amino acids 1-257 of Q96DV8_V1 (SEQ ID NO:395), which also corresponds to amino acids 1-257 of Z40511_P5 (SEQ ID NO:367), and a second amino acid sequence being at least 70%, optionally at least 80%, preferably at least 85%, more preferably at least 90% and most preferably at least 95% homologous to a polypeptide having the sequence IPPMEDFWTTMTTGPGETTTTLCTMTPNNGIWPGMRINCSLFISAYPVELIST corresponding to amino acids 258-310 of Z40511_P5 (SEQ ID NO:367), wherein said first amino acid sequence and second amino acid sequence are contiguous and in a sequential order.

2. An isolated polypeptide encoding for a tail of Z40511_P5 (SEQ ID NO:367) comprising a polypeptide being at least 70%, optionally at least about 80%, preferably at least about 85%, more preferably at least about 90% and most preferably at least about 95% homologous to the sequence IPPMEDFWTTMTTGPGETTTTLCTMTPNNGIWPGMRINCSLFISAYPVELIST in Z40511_P5 (SEQ ID NO:367).

It should be noted that the known protein sequence (Q96DV8) has one or more changes than the sequence given at the end of the application and named as being the amino acid sequence for Q96DV8_V1 (SEQ ID NO:395). These changes were previously known to occur and are listed in the table below.

TABLE 366

| Changes to Q96DV8_V1 (SEQ ID NO:395) | |
|---|---|
| SNP position(s) on amino acid sequence | Type of change |
| 123 | Public snp replace |

Comparison report between Z40511_P5 (SEQ ID NO:367) and AAQ89137 (SEQ ID NO:397) (SEQ ID NO: 397):

1. An isolated chimeric polypeptide encoding for Z40511_P5 (SEQ ID NO:367) comprising a first amino acid sequence being at least 90% homologous to MVYKTLFALCILTAGWRVQSLPTSAPLSVSLPTNIVPPTTIWTSSPQNTDADTASPSNGT HNNSVLPVTASAPTSLLPKNISIESREEEITSPGSNWEGTNTD PSPSGFSSTSGGVHLTTTL EEHSSGTPEAGVAATLSQSAAEPPTLISPQAPASSPSSLSTSPPEVFSASVTTNHSSTVTST QPTGAPTAPESPTEESSSDHTPTSHATAEPVPQEKTPPTTV SGKVMCELIDMETTTTFPR VIMQEVEHALSSG corresponding to amino acids 1-257 of AAQ89137 (SEQ ID NO:397), which also corresponds to amino acids 1-257 of Z40511_P5 (SEQ ID NO:367), and a second amino acid sequence being at least 70%, optionally at least 80%, preferably at least 85%, more preferably at least 90% and most preferably at least 95% homologous to a polypeptide having the sequence IPPMEDFWTTMTTGPGETTTTLCTMTPNNGIWPGMRINCSLFISAYPVELIST corresponding to amino acids 258-310 of Z40511_P5 (SEQ ID NO:367), wherein said first amino acid sequence and second amino acid sequence are contiguous and in a sequential order.

2. An isolated polypeptide encoding for a tail of Z40511_P5 (SEQ ID NO:367) comprising a polypeptide being at least 70%, optionally at least about 80%, preferably at least about 85%, more preferably at least about 90% and most preferably at least about 95% homologous to the sequence IPPMEDFWTTMTTGPGETTTTLCTMTPNNGIWPGMRINCSLFISAYPVELIST in Z40511_P5 (SEQ ID NO:367).

The location of the variant protein was determined according to results from a number of different software programs and analyses, including analyses from SignalP and other specialized programs. The variant protein is believed to be located as follows with regard to the cell: secreted. The protein localization is believed to be secreted because, both signal-peptide prediction programs predict that this protein has a signal peptide, and neither trans-membrane region prediction program predicts that this protein has a trans-membrane region.

Variant protein Z40511_P5 (SEQ ID NO:367) also has the following non-silent SNPs (Single Nucleotide Polymorphisms) as listed in Table 367, (given according to their position(s) on the amino acid sequence, with the alternative amino acid(s) listed; the last column indicates whether the SNP is known or not; the presence of known SNPs in variant protein Z40511_P5 (SEQ ID NO:367) sequence provides support for the deduced sequence of this variant protein according to the present invention).

TABLE 367

| Amino acid mutations | | |
|---|---|---|
| SNP position(s) on amino acid sequence | Alternative amino acid(s) | Previously known SNP? |
| 123 | E -> K | Yes |
| 127 | S -> L | Yes |
| 300 | I -> T | No |

Variant protein Z40511_P5 (SEQ ID NO:367) is encoded by the following transcript(s): Z40511_T8 (SEQ ID NO:43), for which the sequence(s) is/are given at the end of the application. The coding portion of transcript Z40511_T8 (SEQ ID NO:43) is shown in bold; this coding portion starts at position 275 and ends at position 1204. The transcript also has the following SNPs as listed in Table 368 (given according to their position on the nucleotide sequence, with the alternative nucleic acid listed; the last column indicates whether the SNP is known or not; the presence of known SNPs in variant protein Z40511_P5 (SEQ ID NO:367) sequence provides support for the deduced sequence of this variant protein according to the present invention).

TABLE 368

Nucleic acid SNPs

| SNP position on nucleotide sequence | Alternative nucleic acid | Previously known SNP? |
|---|---|---|
| 210 | G -> T | No |
| 255 | G -> C | No |
| 328 | A -> G | No |
| 641 | G -> A | Yes |
| 654 | C -> T | Yes |
| 823 | C -> T | No |
| 862 | G -> A | Yes |
| 919 | A -> G | Yes |
| 1173 | T -> C | No |
| 1281 | T -> A | No |
| 1282 | G -> A | No |
| 1435 | C -> T | Yes |
| 1577 | C -> T | Yes |
| 1668 | A -> G | Yes |
| 1791 | T -> C | Yes |
| 2084 | C -> T | Yes |
| 2412 | A -> C | Yes |
| 2483 | G -> A | Yes |
| 2523 | A -> T | Yes |
| 2703 | G -> A | Yes |
| 3131 | C -> T | Yes |
| 3274 | A -> G | Yes |
| 3501 | C -> T | Yes |
| 3518 | C -> G | Yes |
| 3559 | T -> | Yes |
| 3752 | T -> G | No |
| 3873 | A -> G | Yes |
| 4024 | A -> G | Yes |
| 4153 | C -> A | No |
| 4747 | -> T | No |

As noted above, cluster Z40511 features 14 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster Z40511_node_4 (SEQ ID NO:271) according to the present invention is supported by 40 libraries. The number of libraries was determined as previously described. This segment can be found in the following transcript(s): Z40511_T8 (SEQ ID NO:43). Table 369 below describes the starting and ending position of this segment on each transcript.

TABLE 369

Segment location on transcripts

| Transcript name | Segment starting position | Segment ending position |
|---|---|---|
| Z40511_T8 (SEQ ID NO:43) | 1 | 317 |

Segment cluster Z40511_node_10 (SEQ ID NO:272) according to the present invention is supported by 49 libraries. The number of libraries was determined as previously described. This segment can be found in the following transcript(s): Z40511_T8 (SEQ ID NO:43). Table 370 below describes the starting and ending position of this segment on each transcript.

TABLE 370

Segment location on transcripts

| Transcript name | Segment starting position | Segment ending position |
|---|---|---|
| Z40511_T8 (SEQ ID NO:43) | 318 | 554 |

Segment cluster Z40511_node_11 (SEQ ID NO:273) according to the present invention is supported by 76 libraries. The number of libraries was determined as previously described. This segment can be found in the following transcript(s): Z40511_T8 (SEQ ID NO:43). Table 371 below describes the starting and ending position of this segment on each transcript.

TABLE 371

Segment location on transcripts

| Transcript name | Segment starting position | Segment ending position |
|---|---|---|
| Z40511_T8 (SEQ ID NO:43) | 555 | 1043 |

Segment cluster Z40511_node_15 (SEQ ID NO:274) according to the present invention is supported by 75 libraries. The number of libraries was determined as previously described. This segment can be found in the following transcript(s): Z40511_T8 (SEQ ID NO:43). Table 372 below describes the starting and ending position of this segment on each transcript.

TABLE 372

Segment location on transcripts

| Transcript name | Segment starting position | Segment ending position |
|---|---|---|
| Z40511_T8 (SEQ ID NO:43) | 1044 | 1442 |

Segment cluster Z40511_node_17 (SEQ ID NO:275) according to the present invention is supported by 57 libraries. The number of libraries was determined as previously described. This segment can be found in the following transcript(s): Z40511_T8 (SEQ ID NO:43). Table 373 below describes the starting and ending position of this segment on each transcript.

TABLE 373

Segment location on transcripts

| Transcript name | Segment starting position | Segment ending position |
|---|---|---|
| Z40511_T8 (SEQ ID NO:43) | 1509 | 1689 |

Segment cluster Z40511_node_18 (SEQ ID NO:276) according to the present invention is supported by 88 libraries. The number of libraries was determined as previously described. This segment can be found in the following transcript(s): Z40511_T8 (SEQ ID NO:43). Table 374 below describes the starting and ending position of this segment on each transcript.

TABLE 374

Segment location on transcripts

| Transcript name | Segment starting position | Segment ending position |
|---|---|---|
| Z40511_T8 (SEQ ID NO:43) | 1690 | 1989 |

Segment cluster Z40511_node_19 (SEQ ID NO:277) according to the present invention is supported by 92 libraries. The number of libraries was determined as previously described. This segment can be found in the following transcript(s): Z40511_T8 (SEQ ID NO:43). Table 375 below describes the starting and ending position of this segment on each transcript.

TABLE 375

Segment location on transcripts

| Transcript name | Segment starting position | Segment ending position |
|---|---|---|
| Z40511_T8 (SEQ ID NO:43) | 1990 | 2320 |

Segment cluster Z40511_node_20 (SEQ ID NO:278) according to the present invention is supported by 115 libraries. The number of libraries was determined as previously described. This segment can be found in the following transcript(s): Z40511_T8 (SEQ ID NO:43). Table 376 below describes the starting and ending position of this segment on each transcript.

TABLE 376

Segment location on transcripts

| Transcript name | Segment starting position | Segment ending position |
|---|---|---|
| Z40511_T8 (SEQ ID NO:43) | 2321 | 3697 |

Segment cluster Z40511_node_21 (SEQ ID NO:279) according to the present invention is supported by 72 libraries. The number of libraries was determined as previously described. This segment can be found in the following transcript(s): Z40511_T8 (SEQ ID NO:43). Table 377 below describes the starting and ending position of this segment on each transcript.

TABLE 377

Segment location on transcripts

| Transcript name | Segment starting position | Segment ending position |
|---|---|---|
| Z40511_T8 (SEQ ID NO:43) | 3698 | 3969 |

Segment cluster Z40511_node_23 (SEQ ID NO:280) according to the present invention is supported by 96 libraries. The number of libraries was determined as previously described. This segment can be found in the following transcript(s): Z40511_T8 (SEQ ID NO:43). Table 378 below describes the starting and ending position of this segment on each transcript.

TABLE 378

Segment location on transcripts

| Transcript name | Segment starting position | Segment ending position |
|---|---|---|
| Z40511_T8 (SEQ ID NO:43) | 3996 | 4511 |

Segment cluster Z40511_node_25 (SEQ ID NO:281) according to the present invention is supported by 89 libraries. The number of libraries was determined as previously described. This segment can be found in the following transcript(s): Z40511_T8 (SEQ ID NO:43). Table 379 below describes the starting and ending position of this segment on each transcript.

TABLE 379

Segment location on transcripts

| Transcript name | Segment starting position | Segment ending position |
|---|---|---|
| Z40511_T8 (SEQ ID NO:43) | 4566 | 4994 |

According to an optional embodiment of the present invention, short segments related to the above cluster are also provided. These segments are up to about 120 bp in length, and so are included in a separate description.

Segment cluster Z40511_node_16 (SEQ ID NO:282) according to the present invention is supported by 41 libraries. The number of libraries was determined as previously described. This segment can be found in the following transcript(s): Z40511_T8 (SEQ ID NO:43). Table 380 below describes the starting and ending position of this segment on each transcript.

TABLE 380

Segment location on transcripts

| Transcript name | Segment starting position | Segment ending position |
|---|---|---|
| Z40511_T8 (SEQ ID NO:43) | 1443 | 1508 |

Segment cluster Z40511_node_22 (SEQ ID NO:283) according to the present invention is supported by 43 libraries. The number of libraries was determined as previously described. This segment can be found in the following transcript(s): Z40511_T8 (SEQ ID NO:43). Table 381 below describes the starting and ending position of this segment on each transcript.

TABLE 381

Segment location on transcripts

| Transcript name | Segment starting position | Segment ending position |
|---|---|---|
| Z40511_T8 (SEQ ID NO:43) | 3970 | 3995 |

Segment cluster Z40511_node_24 (SEQ ID NO:284) according to the present invention is supported by 61 libraries. The number of libraries was determined as previously described. This segment can be found in the following transcript(s): Z40511_T8 (SEQ ID NO:43). Table 382 below describes the starting and ending position of this segment on each transcript.

TABLE 382

| | Segment location on transcripts | |
|---|---|---|
| Transcript name | Segment starting position | Segment ending position |
| Z40511_T8 (SEQ ID NO:43) | 4512 | 4565 |

Variant Protein Alignment to the Previously Known Protein:

Sequence name: Q9Y4S1_V2 (SEQ ID NO:396)
Sequence documentation:
Alignment of: Z40511_P5 (SEQ ID NO:367) × Q9Y4S1_V2 (SEQ ID NO:396) . . .
Alignment segment 1/1:
Quality: 2321.00
Escore: 0
Matching length: 243
Total length: 243
Matching Percent Similarity: 98.77
Matching Percent Identity: 98.77
Total Percent Similarity: 98.77
Total Percent Identity: 98.77
Gaps: 0
Alignment:

```
  1  MVYKTLFALCILTAGWRVQSLPTSAPLSVSLPTNIVPPTTIWTSSPQNTD    50
     ||||||||||||||||||||||||||||||||||||||||||||||||||
  1  MVYKTLFALCILTAGWRVQSLPTSAPLSVSLPTNIVPPTTIWTSSPQNTD    50

51  ADTASPSNGTHNNSVLPVTASAPTSLLPKNISIESREEEITSPGSNWEGT   100
     ||||||||||||||||||||||||||||||||||||||||||||||||||
 51  ADTASPSNGTHNNSVLPVTASAPTSLLPKNISIESREEEITSPGSNWEGT   100

101  NTDPSPSGFSSTSGGVHLTTTLEEHSSGTPEAGVAATLSQSAAEPPTLIS   150
     ||||||||||||||||||||||||||||||||||||||||||||||||||
101  NTDPSPSGFSSTSGGVHLTTTLEEHSSGTPEAGVAATLSQSAAEPPTLIS   150

151  PQAPASSPSSLSTSPPEVFSASVTTNHSSTVTSTQPTGAPTAPESPTEES   200
     ||||||||||||||||||||||||||||||||||||||||||||||||||
151  PQAPASSPSSLSTSPPEVFSASVTTNHSSTVTSTQPTGAPTAPESPTEES   200

201  SSDHTPTSHATAEPVPQEKTPPTTVSGKVMCELIDMETTTTFP          243
     ||||||||||||||||||||||||||||||||||||||    ||
201  SSDHTPTSHATAEPVPQEKTPPTTVSGKVMCELIDMETPPPFP          243
```

Sequence name: Q96DV8_V1 (SEQ ID NO:395)
Sequence documentation:
Alignment of: Z40511_P5 (SEQ ID NO:367) × Q96DV8_V1 (SEQ ID NO:395) . . .
Alignment segment 1/1:
Quality: 2493.00
Escore: 0
Matching length: 257
Total length: 257
Matching Percent Similarity: 100.00
Matching Percent Identity: 100.00
Total Percent Similarity: 100.00
Total Percent Identity: 100.00
Gaps: 0
Alignment:

```
  1  MVYKTLFALCILTAGWRVQSLPTSAPLSVSLPTNIVPPTTIWTSSPQNTD    50
     ||||||||||||||||||||||||||||||||||||||||||||||||||
  1  MVYKTLFALCILTAGWRVQSLPTSAPLSVSLPTNIVPPTTIWTSSPQNTD    50

51  ADTASPSNGTHNNSVLPVTASAPTSLLPKNISIESREEEITSPGSNWEGT   100
     ||||||||||||||||||||||||||||||||||||||||||||||||||
 51  ADTASPSNGTHNNSVLPVTASAPTSLLPKNISIESREEEITSPGSNWEGT   100
```

```
101  NTDPSPSGFSSTSGGVHLTTTLEEHSSGTPEAGVAATLSQSAAEPPTLIS  150
     |||||||||||||||||||||||||||||||||||||||||||||||||
101  NTDPSPSGFSSTSGGVHLTTTLEEHSSGTPEAGVAATLSQSAAEPPTLIS  150

151  PQAPASSPSSLSTSPPEVFSASVTTNHSSTVTSTQPTGAPTAPESPTEES  200
     |||||||||||||||||||||||||||||||||||||||||||||||||
151  PQAPASSPSSLSTSPPEVFSASVTTNHSSTVTSTQPTGAPTAPESPTEES  200

201  SSDHTPTSHATAEPVPQEKTPPTTVSGKVMCELIDMETTTTFPRVIMQEV  250
     |||||||||||||||||||||||||||||||||||||||||||||||||
201  SSDHTPTSHATAEPVPQEKTPPTTVSGKVMCELIDMETTTTFPRVIMQEV  250

251  EHALSSG  257
     |||||||
251  EHALSSG  257
```

Sequence name: AAQ89137 (SEQ ID NO:397)

Sequence documentation:

Alignment of: Z40511_P5 (SEQ ID NO:367) × AAQ89137 (SEQ ID NO:397) . . .

Alignment segment 1/1:

Quality: 2493.00

Escore: 0

Matching length: 257

Total length: 257

Matching Percent Similarity: 100.00

Matching Percent Identity: 100.00

Total Percent Similarity: 100.00

Total Percent Identity: 100.00

Gaps: 0

Alignment:

```
  1  MVYKTLFALCILTAGWRVQSLPTSAPLSVSLPTNIVPPTTIWTSSPQNTD   50
     ||||||||||||||||||||||||||||||||||||||||||||||||||
  1  MVYKTLFALCILTAGWRVQSLPTSAPLSVSLPTNIVPPTTIWTSSPQNTD   50

51  ADTASPSNGTHNNSVLTVTASAPTSLLPKNISIESREEEITSPGSNWEGT  100
     ||||||||||||||| ||||||||||||||||||||||||||||||||||
 51  ADTASPSNGTHNNSVLPVTASAPTSLLPKNISIESREEEITSPGSNWEGT  100

101  NTDPSPSGFSSTSGGVHLTTTLEEHSSGTPEAGVAATLSQSAAEPPTLIS  150
     |||||||||||||||||||||||||||||||||||||||||||||||||
101  NTDPSPSGFSSTSGGVHLTTTLEEHSSGTPEAGVAATLSQSAAEPPTLIS  150

151  PQAPASSPSSLSTSPPEVFSASVTTNHSSTVTSTQPTGAPTAPESPTEES  200
     |||||||||||||||||||||||||||||||||||||||||||||||||
151  PQAPASSPSSLSTSPPEVFSASVTTNHSSTVTSTQPTGAPTAPESPTEES  200

201  SSDHTPTSHATAEPVPQEKTPPTTVSGKVMCELIDMETTTTFPRVIMQEV  250
     |||||||||||||||||||||||||||||||||||||||||||||||||
201  SSDHTPTSHATAEPVPQEKTPPTTVSGKVMCELIDMETTTTFPRVIMQEV  250

251  EHALSSG  257
     |||||||
251  EHALSSG  257
```

Description for Cluster H53626

Cluster H53626 features 2 transcript(s) and 20 segment(s) of interest, the names for which are given in Tables 383 and 384, respectively, the sequences themselves are given at the end of the application. The selected protein variants are given in table 385.

TABLE 383

Transcripts of interest

| Transcript Name | Sequence ID No. |
|---|---|
| H53626_PEA_1_T15 | 44 |
| H53626_PEA_1_T16 | 45 |

TABLE 384

Segments of interest

| Segment Name | Sequence ID No. |
|---|---|
| H53626_PEA_1_node_15 | 285 |
| H53626_PEA_1_node_22 | 286 |
| H53626_PEA_1_node_25 | 287 |
| H53626_PEA_1_node_26 | 288 |
| H53626_PEA_1_node_27 | 289 |
| H53626_PEA_1_node_34 | 290 |
| H53626_PEA_1_node_35 | 291 |
| H53626_PEA_1_node_36 | 292 |
| H53626_PEA_1_node_11 | 293 |
| H53626_PEA_1_node_12 | 294 |
| H53626_PEA_1_node_16 | 295 |
| H53626_PEA_1_node_19 | 296 |
| H53626_PEA_1_node_20 | 297 |
| H53626_PEA_1_node_24 | 298 |
| H53626_PEA_1_node_28 | 299 |
| H53626_PEA_1_node_29 | 300 |
| H53626_PEA_1_node_30 | 301 |
| H53626_PEA_1_node_31 | 302 |
| H53626_PEA_1_node_32 | 303 |
| H53626_PEA_1_node_33 | 304 |

TABLE 385

Proteins of interest

| Protein Name | Sequence ID No. |
|---|---|
| H53626_PEA_1_P4 | 368 |
| H53626_PEA_1_P5 | 369 |

Cluster H53626 can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 16 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 16 and Table 386. This cluster is overexpressed (at least at a minimum level) in the following pathological conditions: epithelial malignant tumors, a mixture of malignant tumors from different tissues and myosarcoma.

TABLE 386

Normal tissue distribution

| Name of Tissue | Number |
|---|---|
| Adrenal | 4 |
| Bone | 239 |
| Brain | 39 |
| Colon | 0 |
| Epithelial | 12 |
| General | 18 |
| head and neck | 0 |
| Kidney | 8 |
| Lung | 26 |
| Breast | 8 |
| Muscle | 0 |
| Ovary | 7 |
| Pancreas | 10 |
| Prostate | 8 |
| Skin | 0 |
| Stomach | 73 |
| Thyroid | 0 |
| Uterus | 0 |

TABLE 387

P values and ratios for expression in cancerous tissue

| Name of Tissue | P1 | P2 | SP1 | R3 | SP2 | R4 |
|---|---|---|---|---|---|---|
| Adrenal | 6.4e−01 | 4.2e−01 | 2.1e−01 | 3.1 | 1.3e−02 | 4.1 |
| Bone | 5.8e−01 | 8.1e−01 | 9.8e−01 | 0.3 | 1 | 0.3 |
| Brain | 2.8e−01 | 3.3e−01 | 8.7e−01 | 0.7 | 9.4e−01 | 0.5 |
| Colon | 2.3e−01 | 1.4e−01 | 1 | 1.2 | 4.6e−01 | 1.9 |
| Epithelial | 7.2e−02 | 3.7e−03 | 5.8e−02 | 1.6 | 1.4e−08 | 4.3 |
| General | 2.7e−03 | 1.8e−05 | 7.8e−04 | 1.6 | 8.2e−13 | 3.0 |
| head and neck | 2.1e−01 | 3.3e−01 | 0.0e+00 | 0.0 | 0.0e+00 | 0.0 |
| Kidney | 7.3e−01 | 5.8e−01 | 5.8e−01 | 1.3 | 4.0e−02 | 2.0 |
| Lung | 8.4e−01 | 5.8e−01 | 7.9e−01 | 0.8 | 3.7e−02 | 2.0 |
| Breast | 6.5e−01 | 2.7e−01 | 6.9e−01 | 1.2 | 7.8e−02 | 1.9 |
| Muscle | 1 | 2.9e−01 | 1 | 1.0 | 3.5e−03 | 4.1 |
| Ovary | 6.7e−01 | 5.6e−01 | 1.5e−01 | 1.7 | 7.0e−02 | 2.7 |
| Pancreas | 2.3e−01 | 2.0e−01 | 3.9e−01 | 1.9 | 8.2e−02 | 2.3 |
| Prostate | 9.0e−01 | 9.0e−01 | 6.7e−01 | 1.1 | 1.3e−01 | 1.9 |
| Skin | 1 | 4.4e−01 | 1 | 1.0 | 4.1e−01 | 2.1 |
| Stomach | 9.0e−01 | 3.4e−01 | 1 | 0.3 | 6.1e−01 | 0.9 |
| Thyroid | 2.4e−01 | 2.4e−01 | 1 | 1.1 | 1 | 1.1 |
| Uterus | 2.1e−01 | 2.4e−01 | 2.9e−01 | 2.5 | 2.6e−01 | 2.2 |

As noted above, cluster H53626 features 2 transcript(s), which were listed in Table 1 above. A description of each variant protein according to the present invention is now provided.

Variant protein H53626_PEA_1_P4 (SEQ ID NO:368) according to the present invention has an amino acid sequence as given at the end of the application; it is encoded by transcript(s) H53626_PEA_1_T15 (SEQ ID NO:44). One or more alignments to one or more previously published protein sequences are given at the end of the application. A brief description of the relationship of the variant protein according to the present invention to each such aligned protein is as follows:

Comparison report between H53626_PEA_1_P4 (SEQ ID NO:368) and Q8N441 (SEQ ID NO:500):

1. An isolated chimeric polypeptide encoding for H53626_PEA_1_P4 (SEQ ID NO:368), comprising a first amino acid sequence being at least 90% homologous to MTPSPLLLLLLPPLLLGAFPPAAAARGP-PKMADKVVPRQVARLGRTVRLQCPVEGDPPP LTM-WTKDGRTIHSGWSRFRV-LPQGLKVKQVEREDAGVYVCKATNGFGSLSVNYTL VV LDDISPGKESLGPDSSSGGQEDPAS- QQWARPRFTQPSKMRRRVIARPVGSSVRLKCVAS GHPRPDITWMKDDQALTR-PEAAEPRKKKWTLSLKNLRPEDSGKYT-CRVSNRAGAINAT YKVDVIQRTRSKPVLTGTHPVNT-TVDFGGTTSFQCKVRSDVKPVIQWLKRVEYGAEGR HNSTIDVGGQKFVVLPTGDVWSRPDG-SYLNKLLITRARQDDAGMYICLGANTMGYSFR SAFLTVLP corresponding to amino acids 1-357 of Q8N441, which also corresponds to amino acids 1-357 of H53626_PEA_1_P4 (SEQ ID NO:368), second amino acid sequence being at least 70%, optionally at least 80%, preferably at least 85%, more preferably at least 90% and most preferably at least 95% homologous to a polypeptide having the sequence GARLPRHATPCWCPDPPPG-PGVPPTGWGPTLPSRAVLARSSAEG-GQPRGTVSTAPGMG LGCSPGLCVGVPLPTSFPLALA (SEQ ID NO: 573) corresponding to amino acids 358-437 of H53626_PEA_1_P4 (SEQ ID NO:368), and a third amino acid sequence being at least 90% homologous to DPKPPG-PPVASSSSATSLPWPVVIGIPAGAV-FILGTLLLWLCQAQKKPCTPAPAPPLPGH RPPG-TARDRSGDKDLPSLAALSAGPGVGLCEEHGSPAAP QHLLGPGPVAGPKLYPKLY TDIHTHTHTHSHTHSH-VEGKVHQHIHYQC corresponding to amino acids 358-504 of Q8N441, which also corresponds to amino acids 438-584 of H53626_PEA_1_P4 (SEQ ID NO:368), wherein said first, second and third amino acid sequences are contiguous and in a sequential order.

2. An isolated polypeptide encoding for an edge portion of H53626_PEA_1_P4 (SEQ ID NO:368), comprising an amino acid sequence being at least 70%, optionally at least about 80%, preferably at least about 85%, more preferably at least about 90% and most preferably at least about 95% homologous to the sequence encoding for GARLPRHAT-PCWCPDPPPGPGVPPTGWGPTLPSRAV-LARSSAEGGQPRGTVSTAPGMG LGCSPGLCVGV-PLPTSFPLALA (SEQ ID NO: 573), corresponding to H53626_PEA_1_P4 (SEQ ID NO:368).

The location of the variant protein was determined according to results from a number of different software programs and analyses, including analyses from SignalP and other specialized programs. The variant protein is believed to be located as follows with regard to the cell: membrane. The protein localization is believed to be membrane because although both signal-peptide prediction programs agree that this protein has a signal peptide, both trans-membrane region prediction programs predict that this protein has a trans-membrane region downstream of this signal peptide.

Variant protein H53626_PEA_1_P4 (SEQ ID NO:368) also has the following non-silent SNPs (Single Nucleotide Polymorphisms) as listed in Table 388, (given according to their position(s) on the amino acid sequence, with the alternative amino acid(s) listed; the last column indicates whether the SNP is known or not; the presence of known SNPs in variant protein H53626_PEA_1_P4 (SEQ ID NO:368) sequence provides support for the deduced sequence of this variant protein according to the present invention).

TABLE 388

Amino acid mutations

| SNP position(s) on amino acid sequence | Alternative amino acid(s) | Previously known SNP? |
|---|---|---|
| 193 | R -> L | Yes |
| 300 | G -> | No |
| 319 | Y -> H | No |
| 442 | P -> Q | Yes |
| 504 | R -> L | Yes |
| 521 | G -> | No |
| 544 | P -> L | Yes |
| 573 | E -> G | No |

Variant protein H53626_PEA_1_P4 (SEQ ID NO:368) is encoded by the following transcript(s): H53626_PEA_1_T15 (SEQ ID NO:44), for which the sequence(s) is/are given at the end of the application. The coding portion of transcript H53626_PEA_1_T15 (SEQ ID NO:44) is shown in bold; this coding portion starts at position 17 and ends at position 1768. The transcript also has the following SNPs as listed in Table 389 (given according to their position on the nucleotide sequence, with the alternative nucleic acid listed; the last column indicates whether the SNP is known or not; the presence of known SNPs in variant protein H53626_PEA_1_P4 (SEQ ID NO:368) sequence provides support for the deduced sequence of this variant protein according to the present invention).

TABLE 389

Nucleic acid SNPs

| SNP position on nucleotide sequence | Alternative nucleic acid | Previously known SNP? |
|---|---|---|
| 76 | G -> A | Yes |
| 340 | G -> T | No |
| 1647 | C -> T | Yes |
| 1734 | A -> G | No |
| 1797 | G -> | No |
| 1948 | A -> G | Yes |
| 2193 | C -> T | Yes |
| 2308 | C -> T | Yes |
| 2333 | C -> G | Yes |
| 2648 | C -> T | Yes |
| 2649 | G -> A | Yes |
| 2765 | C -> T | Yes |
| 594 | G -> T | Yes |
| 2972 | G -> A | Yes |
| 3027 | C -> G | Yes |
| 907 | T -> C | Yes |
| 916 | C -> | No |
| 971 | T -> C | No |
| 1135 | G -> A | Yes |
| 1341 | C -> A | Yes |
| 1527 | G -> T | Yes |
| 1579 | C -> | No |

Variant protein H53626_PEA_1_P5 (SEQ ID NO:369) according to the present invention has an amino acid sequence as given at the end of the application; it is encoded by transcript(s) H53626_PEA_1_T16 (SEQ ID NO:45). One or more alignments to one or more previously published protein sequences are given at the end of the application. A brief description of the relationship of the variant protein according to the present invention to each such aligned protein is as follows:

Comparison report between H53626_PEA_1_P5 (SEQ ID NO:369) and Q9H4D7 (SEQ ID NO:501):

1. An isolated chimeric polypeptide encoding for H53626_PEA_1_P5 (SEQ ID NO:369), comprising a first amino acid sequence being at least 90% homologous to MTPSPLLLLLLPPLLLGAFPPAAAARGP-PKMADKVVPRQVARLGRTVRLQCPVEGDPPP LTM-WTKDGRTIHSGWSRFRV-LPQGLKVKQVEREDAGVYVCKATNGFGSLSVNYTL VV LDDISPGKESLGPDSSSGGQEDPAS-QQWARPRFTQPSKMRRRVIARPVGSSVRLKCVAS GHPRPDITWMKDDQALTR-PEAAEPRKKKWTLSLKNLRPEDSGKYT-CRVSNRAGAINAT YKVDVIQRTRSKPVLTGTHPVNT-TVDFGGTTSFQCK corresponding to amino acids 1-269 of Q9H4D7, which also corresponds to amino acids 1-269 of H53626_PEA_1_P5 (SEQ ID NO:369), and a second amino acid sequence being at least 70%, optionally at least 80%, preferably at least 85%, more preferably at least 90% and most preferably at least 95% homologous to a polypeptide having the sequence TQNRQGHLWPPRPRPLACRG-PWSSASQPALSSSWAPCSCGFAR-PRRSRAPPRLPLPCLG TARRGRPATAAETRTFPRWPPSALA-LVWGCVRSMGLRQPPSTYWAQAQLLALSCTPNS TQTSTHTHTHTLTHTHTWRARSTSTSTI-SARRHRICSGHGGAGQTGRLGGWRTELQTKA GDP-WRGGMASTPGSLCVRHSPWTHTHRHTH-YLDACMHTHARTRAP (SEQ ID NO: 574) corresponding to amino acids 270-490 of H53626_PEA_1_P5 (SEQ ID NO:369), wherein said first and second amino acid sequences are contiguous and in a sequential order.

2. An isolated polypeptide encoding for a tail of H53626_PEA_1_P5 (SEQ ID NO:369), comprising a polypeptide being at least 70%, optionally at least about 80%, preferably at least about 85%, more preferably at least about 90% and most preferably at least about 95% homologous to the sequence TQNRQGHLWPPRPRPLACRGP-WSSASQPALSSSWAPCSCGFAR-PRRSRAPPRLPLPCLG TARRGRPATAAETRTFPRWPPSALA-LVWGCVRSMGLRQPPSTYWAQAQLLALSCTPNS TQTSTHTHTHTLTHTHTWRARSTSTSTI-SARRHRICSGHGGAGQTGRLGGWRTELQTKA GDP-WRGGMASTPGSLCVRHSPWTHTHRHTH-YLDACMHTHARTRAP (SEQ ID NO: 574) in H53626_PEA_1_P5 (SEQ ID NO:369).

Comparison report between H53626_PEA_1_P5 (SEQ ID NO:369) and Q8N441:

1. An isolated chimeric polypeptide encoding for H53626_PEA_1_P5 (SEQ ID NO:369), comprising a first amino acid sequence being at least 90% homologous to MTPSPLLLLLLPPLLLGAFPPAAAARGP-PKMADKVVPRQVARLGRTVRLQCPVEGDPPP LTM-WTKDGRTIHSGWSRFRV-LPQGLKVKQVEREDAGVYVCKATNGFGSLSVNYT LVV LDDISPGKESLGPDSSSGGQEDPAS-QQWARPRFTQPSKMRRRVIARPVGSSVRLKCVAS GHPRPDITWMKDDQALTR-PEAAEPRKKKWTLSLKNLRPEDSGKYT-CRVSNRAGAINAT YKVDVIQRTRSKPVLTGTHPVNT-TVDFGGTTSFQCK corresponding to amino acids 1-269 of Q8N441, which also corresponds to amino acids 1-269 of H53626_PEA_1_P5 (SEQ ID NO:369), and a second amino acid sequence being at least 70%, optionally at least 80%, preferably at least 85%, more preferably at least 90% and most preferably at least 95% homologous to a polypeptide having the sequence TQNRQGHLWPPRPRPLACRG-PWSSASQPALSSSWAPCSCGFAR-PRRSRAPPRLPLPCLG TARRGRPATAAETRTFPRWPPSALA-LVWGCVRSMGLRQPPSTYWAQAQLLALSCTPNS TQTSTHTHTHTLTHTHTWRARSTSTSTI-SARRHRICSGHGGAGQTGRLGGWRTELQTKA GDP-WRGGMASTPGSLCVRHSPWTHTHRHTH-YLDACMHTHARTRAP (SEQ ID NO: 574) corresponding to amino acids 270-490 of H53626_PEA_1_P5 (SEQ ID NO:369), wherein said first and second amino acid sequences are contiguous and in a sequential order.

2. An isolated polypeptide encoding for a tail of H53626_PEA_1_P5 (SEQ ID NO:369), comprising a polypeptide being at least 70%, optionally at least about 80%, preferably at least about 85%, more preferably at least about 90% and most preferably at least about 95% homologous to the sequence TQNRQGHLWPPRPRPLACRGP-WSSASQPALSSSWAPCSCGFAR-PRRSRAPPRLPLPCLG TARRGRPATAAETRTFPRWPPSALA-LVWGCVRSMGLRQPPSTYWAQAQLLALSCTPNS TQTSTHTHTHTLTHTHTWRARSTSTSTI-SARRHRICSGHGGAGQTGRLGGWRTELQTKA GDP-WRGGMASTPGSLCVRHSPWTHTHRHTH-YLDACMHTHARTRAP (SEQ ID NO: 574) in H53626_PEA_1_P5 (SEQ ID NO:369).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein H53626_PEA_1_P5 (SEQ ID NO:369) also has the following non-silent SNPs (Single Nucleotide Polymorphisms) as listed in Table 390, (given according to their position(s) on the amino acid sequence, with the alternative amino acid(s) listed; the last column indicates whether the SNP is known or not; the presence of known SNPs in variant protein H53626_PEA_1_P5 (SEQ ID NO:369) sequence provides support for the deduced sequence of this variant protein according to the present invention).

TABLE 390

| Amino acid mutations | | |
|---|---|---|
| SNP position(s) on amino acid sequence | Alternative amino acid(s) | Previously known SNP? |
| 193 | R -> L | Yes |
| 274 | Q -> K | Yes |
| 336 | A -> S | Yes |
| 353 | A -> | No |
| 376 | Q -> * | Yes |
| 405 | R -> G | No |
| 426 | G -> | No |
| 476 | Y -> C | Yes |

Variant protein H53626_PEA_1_P5 (SEQ ID NO:369) is encoded by the following transcript(s): H53626_PEA_1_T16 (SEQ ID NO:45), for which the sequence(s) is/are given at the end of the application. The coding portion of transcript H53626_PEA_1_T16 (SEQ ID NO:45) is shown in bold; this coding portion starts at position 17 and ends at position 1486. The transcript also has the following SNPs as listed in Table 391 (given according to their position on the nucleotide sequence, with the alternative nucleic acid listed; the last column indicates whether the SNP is known or not; the presence of known SNPs in variant protein H53626_PEA_1_P5 (SEQ ID NO:369) sequence provides support for the deduced sequence of this variant protein according to the present invention).

TABLE 391

Nucleic acid SNPs

| SNP position on nucleotide sequence | Alternative nucleic acid | Previously known SNP? |
|---|---|---|
| 76 | G -> A | Yes |
| 340 | G -> T | No |
| 1688 | C -> T | Yes |
| 1803 | C -> T | Yes |
| 1828 | C -> G | Yes |
| 2143 | C -> T | Yes |
| 2144 | G -> A | Yes |
| 2260 | C -> T | Yes |
| 2467 | G -> A | Yes |
| 2522 | C -> G | Yes |
| 594 | G -> T | Yes |
| 836 | C -> A | Yes |
| 1022 | G -> T | Yes |
| 1074 | C -> | No |
| 1142 | C -> T | Yes |
| 1229 | A -> G | No |
| 1292 | G -> | No |
| 1443 | A -> G | Yes |

As noted above, cluster H53626 features 20 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster H53626_PEA_1_node_15 (SEQ ID NO:285) according to the present invention is supported by 25 libraries. The number of libraries was determined as previously described. This segment can be found in the following transcript(s): H53626_PEA_1_T15 (SEQ ID NO:44) and H53626_PEA_1_T16 (SEQ ID NO:45). Table 392 below describes the starting and ending position of this segment on each transcript.

TABLE 392

Segment location on transcripts

| Transcript name | Segment starting position | Segment ending position |
|---|---|---|
| H53626_PEA_1_T15 (SEQ ID NO:44) | 96 | 343 |
| H53626_PEA_1_T16 (SEQ ID NO:45) | 96 | 343 |

Segment cluster H53626_PEA_1_node_22 (SEQ ID NO:286) according to the present invention is supported by 42 libraries. The number of libraries was determined as previously described. This segment can be found in the following transcript(s): H53626_PEA_1_T 15 (SEQ ID NO:44) and H53626_PEA_1_T16 (SEQ ID NO:45). Table 393 below describes the starting and ending position of this segment on each transcript.

TABLE 393

Segment location on transcripts

| Transcript name | Segment starting position | Segment ending position |
|---|---|---|
| H53626_PEA_1_T15 (SEQ ID NO:44) | 450 | 734 |
| H53626_PEA_1_T16 (SEQ ID NO:45) | 450 | 734 |

Segment cluster H53626_PEA_1_node_25 (SEQ ID NO:287) according to the present invention is supported by 41 libraries. The number of libraries was determined as previously described. This segment can be found in the following transcript(s): H53626_PEA_1_T15 (SEQ ID NO:44). Table 394 below describes the starting and ending position of this segment on each transcript.

TABLE 394

Segment location on transcripts

| Transcript name | Segment starting position | Segment ending position |
|---|---|---|
| H53626_PEA_1_T15 (SEQ ID NO:44) | 824 | 1088 |

Segment cluster H53626_PEA_1_node_26 (SEQ ID NO:288) according to the present invention is supported by 5 libraries. The number of libraries was determined as previously described. This segment can be found in the following transcript(s): H53626_PEA_1_T 5 (SEQ ID NO:44). Table 395 below describes the starting and ending position of this segment on each transcript.

TABLE 395

Segment location on transcripts

| Transcript name | Segment starting position | Segment ending position |
|---|---|---|
| H53626_PEA_1_T15 (SEQ ID NO:44) | 1089 | 1328 |

Microarray (chip) data is also available for this segment as follows. As described above with regard to the cluster itself, various oligonucleotides were tested for being differentially expressed in various disease conditions, particularly cancer. The following oligonucleotides were found to hit this segment (with regard to prostate cancer), shown in Table 396.

TABLE 396

Oligonucleotides related to this segment

| Oligonucleotide name | Overexpressed in cancers | Chip reference |
|---|---|---|
| H53626_0_0_8391 | prostate cancer | PRO |

Segment cluster H53626_PEA_1_node_27 (SEQ ID NO:289) according to the present invention is supported by 106 libraries. The number of libraries was determined as previously described. This segment can be found in the following transcript(s): H53626_PEA_1_T15 (SEQ ID NO:44) and H53626_PEA_1_T16 (SEQ ID NO:45). Table 397 below describes the starting and ending position of this segment on each transcript.

TABLE 397

| Transcript name | Segment location on transcripts | |
|---|---|---|
| | Segment starting position | Segment ending position |
| H53626_PEA_1_T15 (SEQ ID NO:44) | 1329 | 2228 |
| H53626_PEA_1_T16 (SEQ ID NO:45) | 824 | 1723 |

Segment cluster H53626_PEA_1_node_34 (SEQ ID NO:290) according to the present invention is supported by 121 libraries. The number of libraries was determined as previously described. This segment can be found in the following transcript(s): H53626_PEA_1_T15 (SEQ ID NO:44) and H53626_PEA_1_T16 (SEQ ID NO:45). Table 398 below describes the starting and ending position of this segment on each transcript.

TABLE 398

| Transcript name | Segment location on transcripts | |
|---|---|---|
| | Segment starting position | Segment ending position |
| H53626_PEA_1_T15 (SEQ ID NO:44) | 2507 | 2977 |
| H53626_PEA_1_T16 (SEQ ID NO:45) | 2002 | 2472 |

Segment cluster H53626_PEA_1_node_35 (SEQ ID NO:291) according to the present invention is supported by 85 libraries. The number of libraries was determined as previously described. This segment can be found in the following transcript(s): H53626_PEA_1_T15 (SEQ ID NO:44) and H53626_PEA_1_T16 (SEQ ID NO:45). Table 399 below describes the starting and ending position of this segment on each transcript.

TABLE 399

| Transcript name | Segment location on transcripts | |
|---|---|---|
| | Segment starting position | Segment ending position |
| H53626_PEA_1_T15 (SEQ ID NO:44) | 2978 | 3148 |
| H53626_PEA_1_T16 (SEQ ID NO:45) | 2473 | 2643 |

Segment cluster H53626_PEA_1_node_36 (SEQ ID NO:292) according to the present invention is supported by 69 libraries. The number of libraries was determined as previously described. This segment can be found in the following transcript(s): H53626_PEA_1_T 15 (SEQ ID NO:44) and H53626_PEA_1_T16 (SEQ ID NO:45). Table 400 below describes the starting and ending position of this segment on each transcript.

TABLE 400

| Transcript name | Segment location on transcripts | |
|---|---|---|
| | Segment starting position | Segment ending position |
| H53626_PEA_1_T15 (SEQ ID NO:44) | 3149 | 3322 |
| H53626_PEA_1_T16 (SEQ ID NO:45) | 2644 | 2817 |

According to an optional embodiment of the present invention, short segments related to the above cluster are also provided. These segments are up to about 120 bp in length, and so are included in a separate description.

Segment cluster H53626_PEA_1_node_11 (SEQ ID NO:293) according to the present invention is supported by 12 libraries. The number of libraries was determined as previously described. This segment can be found in the following transcript(s): H53626_PEA_1_T 15 (SEQ ID NO:44) and H53626_PEA_1_T16 (SEQ ID NO:45). Table 401 below describes the starting and ending position of this segment on each transcript.

TABLE 401

| Transcript name | Segment location on transcripts | |
|---|---|---|
| | Segment starting position | Segment ending position |
| H53626_PEA_1_T15 (SEQ ID NO:44) | 1 | 55 |
| H53626_PEA_1_T16 (SEQ ID NO:45) | 1 | 55 |

Segment cluster H53626_PEA_1_node_12 (SEQ ID NO:294) according to the present invention is supported by 11 libraries. The number of libraries was determined as previously described. This segment can be found in the following transcript(s): H53626_PEA_1_T 15 (SEQ ID NO:44) and H53626_PEA_1_T16 (SEQ ID NO:45). Table 402 below describes the starting and ending position of this segment on each transcript.

TABLE 402

| Transcript name | Segment location on transcripts | |
|---|---|---|
| | Segment starting position | Segment ending position |
| H53626_PEA_1_T15 (SEQ ID NO:44) | 56 | 95 |
| H53626_PEA_1_T16 (SEQ ID NO:45) | 56 | 95 |

Segment cluster H53626_PEA_1_node_16 (SEQ ID NO:295) according to the present invention can be found in the following transcript(s): H53626_PEA_1_T15 (SEQ ID NO:44) and H53626_PEA_1_T16 (SEQ ID NO:45). Table 403 below describes the starting and ending position of this segment on each transcript.

TABLE 403

Segment location on transcripts

| Transcript name | Segment starting position | Segment ending position |
|---|---|---|
| H53626_PEA_1_T15 (SEQ ID NO:44) | 344 | 368 |
| H53626_PEA_1_T16 (SEQ ID NO:45) | 344 | 368 |

Segment cluster H53626_PEA_1_node_19 (SEQ ID NO:296) according to the present invention is supported by 25 libraries. The number of libraries was determined as previously described. This segment can be found in the following transcript(s): H53626_PEA_1_T15 (SEQ ID NO:44) and H53626_PEA_1_T16 (SEQ ID NO:45). Table 404 below describes the starting and ending position of this segment on each transcript.

TABLE 404

Segment location on transcripts

| Transcript name | Segment starting position | Segment ending position |
|---|---|---|
| H53626_PEA_1_T15 (SEQ ID NO:44) | 369 | 419 |
| H53626_PEA_1_T16 (SEQ ID NO:45) | 369 | 419 |

Segment cluster H53626_PEA_1_node_20 (SEQ ID NO:297) according to the present invention is supported by 27 libraries. The number of libraries was determined as previously described. This segment can be found in the following transcript(s): H53626_PEA_1_T 15 (SEQ ID NO:44) and H53626_PEA_1_T16 (SEQ ID NO:45). Table 405 below describes the starting and ending position of this segment on each transcript.

TABLE 405

Segment location on transcripts

| Transcript name | Segment starting position | Segment ending position |
|---|---|---|
| H53626_PEA_1_T15 (SEQ ID NO:44) | 420 | 449 |
| H53626_PEA_1_T16 (SEQ ID NO:45) | 420 | 449 |

Segment cluster H53626_PEA_1_node_24 (SEQ ID NO:298) according to the present invention is supported by 34 libraries. The number of libraries was determined as previously described. This segment can be found in the following transcript(s): H53626_PEA_1_T15 (SEQ ID NO:44) and H53626_PEA_1_T16 (SEQ ID NO:45). Table 406 below describes the starting and ending position of this segment on each transcript.

TABLE 406

Segment location on transcripts

| Transcript name | Segment starting position | Segment ending position |
|---|---|---|
| H53626_PEA_1_T15 (SEQ ID NO:44) | 735 | 823 |

TABLE 406-continued

Segment location on transcripts

| Transcript name | Segment starting position | Segment ending position |
|---|---|---|
| H53626_PEA_1_T16 (SEQ ID NO:45) | 735 | 823 |

Segment cluster H53626_PEA_1_node_28 (SEQ ID NO:299) according to the present invention is supported by 66 libraries. The number of libraries was determined as previously described. This segment can be found in the following transcript(s): H53626_PEA_1_T 15 (SEQ ID NO:44) and H53626_PEA_1_T16 (SEQ ID NO:45). Table 407 below describes the starting and ending position of this segment on each transcript.

TABLE 407

Segment location on transcripts

| Transcript name | Segment starting position | Segment ending position |
|---|---|---|
| H53626_PEA_1_T15 (SEQ ID NO:44) | 2229 | 2306 |
| H53626_PEA_1_T16 (SEQ ID NO:45) | 1724 | 1801 |

Segment cluster H53626_PEA_1_node_29 (SEQ ID NO:300) according to the present invention is supported by 73 libraries. The number of libraries was determined as previously described. This segment can be found in the following transcript(s): H53626_PEA_1_T15 (SEQ ID NO:44) and H53626_PEA_1_T16 (SEQ ID NO:45). Table 408 below describes the starting and ending position of this segment on each transcript.

TABLE 408

Segment location on transcripts

| Transcript name | Segment starting position | Segment ending position |
|---|---|---|
| H53626_PEA_1_T15 (SEQ ID NO:44) | 2307 | 2396 |
| H53626_PEA_1_T16 (SEQ ID NO:45) | 1802 | 1891 |

Segment cluster H53626_PEA_1_node_30 (SEQ ID NO:301) according to the present invention is supported by 71 libraries. The number of libraries was determined as previously described. This segment can be found in the following transcript(s): H53626_PEA_1_T15 (SEQ ID NO:44) and H53626_PEA_1_T16 (SEQ ID NO:45). Table 409 below describes the starting and ending position of this segment on each transcript.

TABLE 409

Segment location on transcripts

| Transcript name | Segment starting position | Segment ending position |
|---|---|---|
| H53626_PEA_1_T15 (SEQ ID NO:44) | 2397 | 2442 |

TABLE 409-continued

Segment location on transcripts

| Transcript name | Segment starting position | Segment ending position |
|---|---|---|
| H53626_PEA_1_T16 (SEQ ID NO:45) | 1892 | 1937 |

Segment cluster H53626_PEA_1_node_31 (SEQ ID NO:302) according to the present invention is supported by 67 libraries. The number of libraries was determined as previously described. This segment can be found in the following transcript(s): H53626_PEA_1_T15 (SEQ ID NO:44) and H53626_PEA_1_T16 (SEQ ID NO:45). Table 410 below describes the starting and ending position of this segment on each transcript.

TABLE 410

Segment location on transcripts

| Transcript name | Segment starting position | Segment ending position |
|---|---|---|
| H53626_PEA_1_T15 (SEQ ID NO:44) | 2443 | 2469 |
| H53626_PEA_1_T16 (SEQ ID NO:45) | 1938 | 1964 |

Segment cluster H53626_PEA_1_node_32 (SEQ ID NO:303) according to the present invention is supported by 65 libraries. The number of libraries was determined as previously described. This segment can be found in the following transcript(s): H53626_PEA_1_T15 (SEQ ID NO:44) and H53626_PEA_1_T16 (SEQ ID NO:45). Table 410 below describes the starting and ending position of this segment on each transcript.

TABLE 410

Segment location on transcripts

| Transcript name | Segment starting position | Segment ending position |
|---|---|---|
| H53626_PEA_1_T15 (SEQ ID NO:44) | 2470 | 2498 |
| H53626_PEA_1_T16 (SEQ ID NO:45) | 1965 | 1993 |

Segment cluster H53626_PEA_1_node_33 (SEQ ID NO:304) according to the present invention can be found in the following transcript(s): H53626_PEA_1_T15 (SEQ ID NO:44) and H53626_PEA_1_T16 (SEQ ID NO:45). Table 411 below describes the starting and ending position of this segment on each transcript.

TABLE 411

Segment location on transcripts

| Transcript name | Segment starting position | Segment ending position |
|---|---|---|
| H53626_PEA_1_T15 (SEQ ID NO:44) | 2499 | 2506 |
| H53626_PEA_1_T16 (SEQ ID NO:45) | 1994 | 2001 |

Expression of *Homo Sapiens* Fibroblast Growth Factor Receptor-Like 1 (FGFRL1) H53626 Transcripts Which are Detectable by Amplicon as Depicted in Sequence Name H53626 junc24-27F1R3 (SEQ ID NO:504) in Different Normal Tissues Expression of *Homo sapiens* fibroblast growth factor receptor-like 1 (FGFRL1) transcripts detectable by or according to H53626 junc24-27F1R3 (SEQ ID NO:504) amplicon (s) and H53626 junc24-27F1 (SEQ ID NO:502) and H53626 junc24-27R3 (SEQ ID NO:503) was measured by real time PCR (these sequences relate to the known protein ("WT") sequence). In parallel the expression of four housekeeping genes—RPL19 (GenBank Accession No. NM_000981 (SEQ ID NO:511); RPL19 amplicon (SEQ ID NO:410)), TATA box (GenBank Accession No. NM_003194 (SEQ ID NO:512); TATA amplicon (SEQ ID NO:515)), UBC (GenBank Accession No. BC000449 (SEQ ID NO:516); amplicon—Ubiquitin—(SEQ ID NO:519)) and SDHA (GenBank Accession No. NM_004168 (SEQ ID NO:508); amplicon_—SDHA-amplicon (SEQ ID NO:407) was measured similarly. For each RT sample, the expression of the above amplicon was normalized to the geometric mean of the quantities of the housekeeping genes.

H53626 junc24-27 Forward primer (SEQ ID NO: 502):
GTCCTTCCAGTGCAAGACCCA

H53626 junc24-27 Reverse primer (SEQ ID NO: 503):
TGGGCCTGGCAAAGCC

H53626 junc24-27 Amplicon (SEQ ID NO: 504):
GTCCTTCCAGTGCAAGACCCAAAACCGCCAGGGCCACCTGTGGCCTCCTC

GTCCTCGGCCACTAGCCTGCCGTGGCCCGTGGTCATCGGCATCCCAGCCG

GCGCTGTCTTCATCCTGGGCACCCTGCTCCTGTGGCTTTGCCAGGCCCA

Expression of *Homo Sapiens* Fibroblast Growth Factor Receptor-Like 1 (FGFRL1) H53626 Transcripts, Which are Detectable by Amplicon as Depicted in Sequence Name H53626 seg25 (SEQ ID NO:507) in Different Normal Tissues.

Expression of *Homo sapiens* fibroblast growth factor receptor-like 1 (FGFRL1) transcripts detectable by or according to H53626 seg25 (SEQ ID NO:507) amplicon(s) and H53626 seg25F (SEQ ID NO:505) and H53626 seg25R (SEQ ID NO:506) was measured by real time PCR. In parallel the expression of four housekeeping genes: RPL19 (GenBank Accession No. NM_000981 (SEQ ID NO:511); RPL19 amplicon (SEQ ID NO:410)), TATA box (GenBank Accession No. NM_003194 (SEQ ID NO:512); TATA amplicon (SEQ ID NO:515)), UBC (GenBank Accession No. BC000449 (SEQ ID NO:516); amplicon—Ubiquitin- amplicon (SEQ ID NO:519)) and SDHA (GenBank Accession No. NM_004168 (SEQ ID NO:508); amplicon_—SDHA-amplicon SEQ ID NO:407)) was measured similarly. For each RT sample, the expression of the above amplicon was normalized to the geometric mean of the quantities of the housekeeping genes.

H53626 seg25 Forward primer (SEQ ID NO: 505):
CCGACGGCTCCTACCTCAA

H53626 seg25 Reverse primer (SEQ ID NO: 506):
GGAAGCTGTAGCCCATGGTGT

H53626 seg25 Amplicon (SEQ ID NO: 507):
CCGACGGCTCCTACCTCAATAAGCTGCTCATCACCCGTGCCCGCCAGGAC

GATGCGGGCATGTACATCTGCCTTGGCGCCAACACCATGGGCTACAGCT

TCC

Variant Protein Alignment to the Previously Known Protein:

Sequence name: /tmp/K1Mec2ReKO/eg1EUS2AXY:Q8N441
Sequence documentation:
Alignment of: H53626_PEA_1_P4 (SEQ ID NO:368) × Q8N441 . . .
Alignment segment 1/1:
Quality: 4882.00
Escore: 0
Matching length: 504
Total length: 584
Matching Percent Similarity: 100.00
Matching Percent Identity: 100.00
Total Percent Similarity: 86.30
Total Percent Identity: 86.30
Gaps: 1
Alignment:

```
  1  MTPSPLLLLLLPPLLLGAFPPAAAARGPPKMADKVVPRQVARLGRTVRLQ   50
     ||||||||||||||||||||||||||||||||||||||||||||||||||
  1  MTPSPLLLLLLPPLLLGAFPPAAAARGPPKMADKVVPRQVARLGRTVRLQ   50

51  CPVEGDPPPLTMWTKDGRTIHSGWSRFRVLPQGLKVKQVEREDAGVYVCK  100
     ||||||||||||||||||||||||||||||||||||||||||||||||||
 51  CPVEGDPPPLTMWTKDGRTIHSGWSRFRVLPQGLKVKQVEREDAGVYVCK  100

101  ATNGFGSLSVNYTLVVLDDISPGKESLGPDSSSGGQEDPASQQWARPRFT  150
     ||||||||||||||||||||||||||||||||||||||||||||||||||
101  ATNGFGSLSVNYTLVVLDDISPGKESLGPDSSSGGQEDPASQQWARPRFT  150

151  QPSKMRRRVIARPVGSSVRLKCVASGHPRPDITWMKDDQALTRPEAAEPR  200
     ||||||||||||||||||||||||||||||||||||||||||||||||||
151  QPSKMRRRVIARPVGSSVRLKCVASGHPRPDITWMKDDQALTRPEAAEPR  200

201  KKKWTLSLKNLRPEDSGKYTCRVSNRAGAINATYKVDVIQRTRSKPVLTG  250
     ||||||||||||||||||||||||||||||||||||||||||||||||||
201  KKKWTLSLKNLRPEDSGKYTCRVSNRAGAINATYKVDVIQRTRSKPVLTG  250

251  THPVNTTVDFGGTTSFQCKVRSDVKPVIQWLKRVEYGAEGRHNSTIDVGG  300
     ||||||||||||||||||||||||||||||||||||||||||||||||||
251  THPVNTTVDFGGTTSFQCKVRSDVKPVIQWLKRVEYGAEGRHNSTIDVGG  300

301  QKFVVLPTGDVWSRPDGSYLNKLLITRARQDDAGMYICLGANTMGYSFRS  350
     ||||||||||||||||||||||||||||||||||||||||||||||||||
301  QKFVVLPTGDVWSRPDGSYLNKLLITRARQDDAGMYICLGANTMGYSFRS  350

351  AFLTVLPGARLPRHATPCWCPDPPPGPGVPPTGWGPTLPSRAVLARSSAE  400
     |||||||
351  AFLTVLP...........................................  357

401  GGQPRGTVSTAPGMGLGCSPGLCVGVPLPTSFPLALADPKPPGPPVASSS  450
                                           ||||||||||||||
358  ..................................DPKPPGPPVASSS  370

451  SATSLPWPVVIGIPAGAVFILGTLLLWLCQAQKKPCTPAPAPPLPGHRPP  500
     ||||||||||||||||||||||||||||||||||||||||||||||||||
371  SATSLPWPVVIGIPAGAVFILGTLLLWLCQAQKKPCTPAPAPPLPGHRPP  420

501  GTARDRSGDKDLPSLAALSAGPGVGLCEEHGSPAAPQHLLGPGPVAGPKL  550
     ||||||||||||||||||||||||||||||||||||||||||||||||||
421  GTARDRSGDKDLPSLAALSAGPGVGLCEEHGSPAAPQHLLGPGPVAGPKL  470

551  YPKLYTDIHTHTHTHSHTHSHVEGKVHQHIHYQC                 584
     |||||||||||||||||||||||||||||||||
471  YPKLYTDIHTHTHTHSHTHSHVEGKVHQHIHYQC                 504
```

Sequence name: /tmp/oSUZaRW3WK/oSh3fN5Zt0:Q9H4D7
Sequence documentation:
Alignment of: H53626_PEA_1_P5 (SEQ ID NO:369) × Q9H4D7 . . .

-continued

Alignment segment 1/1:
Quality: 2644.00
Escore: 0
Matching length: 269
Total length: 269
Matching Percent Similarity: 100.00
Matching Percent Identity: 100.00
Total Percent Similarity: 100.00
Total Percent Identity: 100.00
Gaps: 0
Alignment:

```
  1  MTPSPLLLLLLPPLLLGAFPPAAAARGPPKMADKVVPRQVARLGRTVRLQ   50
     ||||||||||||||||||||||||||||||||||||||||||||||||||
  1  MTPSPLLLLLLPPLLLGAFPPAAAARGPPKMADKVVPRQVARLGRTVRLQ   50

51  CPVEGDPPPLTMWTKDGRTIHSGWSRFRVLPQGLKVKQVEREDAGVYVCK  100
     ||||||||||||||||||||||||||||||||||||||||||||||||||
 51  CPVEGDPPPLTMWTKDGRTIHSGWSRFRVLPQGLKVKQVEREDAGVYVCK  100

101  ATNGFGSLSVNYTLVVLDDISPGKESLGPDSSSGGQEDPASQQWARPRFT  150
     ||||||||||||||||||||||||||||||||||||||||||||||||||
101  ATNGFGSLSVNYTLVVLDDISPGKESLGPDSSSGGQEDPASQQWARPRFT  150

151  QPSKMRRRVIARPVGSSVRLKCVASGHPRPDITWMKDDQALTRPEAAEPR  200
     ||||||||||||||||||||||||||||||||||||||||||||||||||
151  QPSKMRRRVIARPVGSSVRLKCVASGHPRPDITWMKDDQALTRPEAAEPR  200

201  KKKWTLSLKNLRPEDSGKYTCRVSNRAGAINATYKVDVIQRTRSKPVLTG  250
     ||||||||||||||||||||||||||||||||||||||||||||||||||
201  KKKWTLSLKNLRPEDSGKYTCRVSNRAGAINATYKVDVIQRTRSKPVLTG  250

251  THPVNTTVDFGGTTSFQCK  269
     |||||||||||||||||||
251  THPVNTTVDFGGTTSFQCK  269
```

Sequence name: /tmp/oSUZaRW3WK/oSh3fN5Zt0:Q8N441
Sequence documentation:
Alignment of: H53626_PEA_1_P5 (SEQ ID NO:369) × Q8N441 . . .
Alignment segment 1/1:
Quality: 2644.00
Escore: 0
Matching length: 269
Total length: 269
Matching Percent Similarity: 100.00
Matching Percent Identity: 100.00
Total Percent Similarity: 100.00
Total Percent Identity: 100.00
Gaps: 0
Alignment:

```
  1  MTPSPLLLLLLPPLLLGAFPPAAAARGPPKMADKVVPRQVARLGRTVRLQ   50
     ||||||||||||||||||||||||||||||||||||||||||||||||||
  1  MTPSPLLLLLLPPLLLGAFPPAAAARGPPKMADKVVPRQVARLGRTVRLQ   50

51  CPVEGDPPPLTMWTKDGRTIHSGWSRFRVLPQGLKVKQVEREDAGVYVCK  100
     ||||||||||||||||||||||||||||||||||||||||||||||||||
 51  CPVEGDPPPLTMWTKDGRTIHSGWSRFRVLPQGLKVKQVEREDAGVYVCK  100

101  ATNGFGSLSVNYTLVVLDDISPGKESLGPDSSSGGQEDPASQQWARPRFT  150
     ||||||||||||||||||||||||||||||||||||||||||||||||||
101  ATNGFGSLSVNYTLVVLDDISPGKESLGPDSSSGGQEDPASQQWARPRFT  150

151  QPSKMRRRVIARPVGSSVRLKCVASGHPRPDITWMKDDQALTRPEAAEPR  200
     ||||||||||||||||||||||||||||||||||||||||||||||||||
151  QPSKMRRRVIARPVGSSVRLKCVASGHPRPDITWMKDDQALTRPEAAEPR  200
```

-continued

```
201  KKKWTLSLKNLRPEDSGKYTCRVSNRAGAINATYKVDVIQRTRSKPVLTG  250
     ||||||||||||||||||||||||||||||||||||||||||||||||||
201  KKKWTLSLKNLRPEDSGKYTCRVSNRAGAINATYKVDVIQRTRSKPVLTG  250

251  THPVNTTVDFGGTTSFQCK                                269
     |||||||||||||||||||
251  THPVNTTVDFGGTTSFQCK                                269
```

Description for Cluster HSMUC1A

Cluster HSMUC1A features 14 transcript(s) and 22 segment(s) of interest, the names for which are given in Tables 412 and 413, respectively, the sequences themselves are given at the end of the application. The selected protein variants are given in table 414.

TABLE 412

Transcripts of interest

| Transcript Name | Sequence ID No. |
|---|---|
| HSMUC1A_PEA_1_T12 | 46 |
| HSMUC1A_PEA_1_T26 | 47 |
| HSMUC1A_PEA_1_T28 | 48 |
| HSMUC1A_PEA_1_T29 | 49 |
| HSMUC1A_PEA_1_T30 | 50 |
| HSMUC1A_PEA_1_T31 | 51 |
| HSMUC1A_PEA_1_T33 | 52 |
| HSMUC1A_PEA_1_T34 | 53 |
| HSMUC1A_PEA_1_T35 | 54 |
| HSMUC1A_PEA_1_T36 | 55 |
| HSMUC1A_PEA_1_T40 | 56 |
| HSMUC1A_PEA_1_T42 | 57 |
| HSMUC1A_PEA_1_T43 | 58 |
| HSMUC1A_PEA_1_T47 | 59 |

TABLE 413

Segments of interest

| Segment Name | Sequence ID No. |
|---|---|
| HSMUC1A_PEA_1_node_0 | 305 |
| HSMUC1A_PEA_1_node_14 | 306 |
| HSMUC1A_PEA_1_node_24 | 307 |
| HSMUC1A_PEA_1_node_29 | 308 |
| HSMUC1A_PEA_1_node_35 | 309 |
| HSMUC1A_PEA_1_node_38 | 310 |
| HSMUC1A_PEA_1_node_3 | 311 |
| HSMUC1A_PEA_1_node_4 | 312 |
| HSMUC1A_PEA_1_node_5 | 313 |
| HSMUC1A_PEA_1_node_6 | 314 |
| HSMUC1A_PEA_1_node_7 | 315 |
| HSMUC1A_PEA_1_node_17 | 316 |
| HSMUC1A_PEA_1_node_18 | 317 |
| HSMUC1A_PEA_1_node_20 | 318 |
| HSMUC1A_PEA_1_node_21 | 319 |
| HSMUC1A_PEA_1_node_23 | 320 |
| HSMUC1A_PEA_1_node_26 | 321 |
| HSMUC1A_PEA_1_node_27 | 322 |
| HSMUC1A_PEA_1_node_31 | 323 |
| HSMUC1A_PEA_1_node_34 | 324 |
| HSMUC1A_PEA_1_node_36 | 325 |
| HSMUC1A_PEA_1_node_37 | 326 |

TABLE 414

Proteins of interest

| Protein Name | Sequence ID No. | Corresponding Transcript(s) |
|---|---|---|
| HSMUC1A_PEA_1_P25 | 370 | HSMUC1A_PEA_1_T26 (SEQ ID NO:47) |
| HSMUC1A_PEA_1_P29 | 371 | HSMUC1A_PEA_1_T33 (SEQ ID NO:52) |
| HSMUC1A_PEA_1_P30 | 372 | HSMUC1A_PEA_1_T34 (SEQ ID NO:53) |
| HSMUC1A_PEA_1_P32 | 373 | HSMUC1A_PEA_1_T36 (SEQ ID NO:55) |
| HSMUC1A_PEA_1_P36 | 374 | HSMUC1A_PEA_1_T40 (SEQ ID NO:56) |
| HSMUC1A_PEA_1_P39 | 375 | HSMUC1A_PEA_1_T43 (SEQ ID NO:58) |
| HSMUC1A_PEA_1_P45 | 376 | HSMUC1A_PEA_1_T29 (SEQ ID NO:49) |
| HSMUC1A_PEA_1_P49 | 377 | HSMUC1A_PEA_1_T12 (SEQ ID NO:46) |
| HSMUC1A_PEA_1_P52 | 378 | HSMUC1A_PEA_1_T30 (SEQ ID NO:50) |
| HSMUC1A_PEA_1_P53 | 379 | HSMUC1A_PEA_1_T31 (SEQ ID NO:51) |
| HSMUC1A_PEA_1_P56 | 380 | HSMUC1A_PEA_1_T42 (SEQ ID NO:57) |
| HSMUC1A_PEA_1_P58 | 381 | HSMUC1A_PEA_1_T35 (SEQ ID NO:54) |
| HSMUC1A_PEA_1_P59 | 382 | HSMUC1A_PEA_1_T28 (SEQ ID NO:48) |
| HSMUC1A_PEA_1_P63 | 383 | HSMUC1A_PEA_1_T47 (SEQ ID NO:59) |

These sequences are variants of the known protein Mucin 1 precursor (SEQ ID NO:398) (SwissProt accession identifier MUC1_HUMAN (SEQ ID NO: 398); known also according to the synonyms MUC-1; Polymorphic epithelial mucin; PEM; PEMT; Episialin; Tumor-associated mucin; Carcinoma-associated mucin; Tumor-associated epithelial membrane antigen; EMA; H23AG; Peanut—reactive urinary mucin; PUM; Breast carcinoma-associated antigen DF3; CD227 antigen), SEQ ID NO: 398, referred to herein as the previously known protein.

Protein Mucin 1 precursor (SEQ ID NO:398) is known or believed to have the following function(s): May play a role in adhesive functions and in cell-cell interactions, metastasis and signaling. May provide a protective layer on epithelial surfaces. Direct or indirect interaction with actin cytoskeleton; Isoform 7 behaves as a receptor and binds the secreted isoform 5. The binding induces the phosphorylation of the isoform 7, alters cellular morphology and initiates cell signaling. Can bind to GRB2 adapter protein. The sequence for protein Mucin 1 precursor (SEQ ID NO:398) is given at the end of the application, as "Mucin 1 precursor (SEQ ID NO:398) amino acid sequence". Known polymorphisms for this sequence are as shown in Table 415.

TABLE 415

Amino acid mutations for Known Protein

| SNP position(s) on amino acid sequence | Comment |
|---|---|
| 1116 | D -> E: NO EFFECT ON BINDING OF ISOFORM 7. |
| 1116 | D -> A: DRASTICALLY REDUCED BINDING OF ISOFORM 7. |
| 2 | T -> A |
| 134 | P -> Q |
| 154 | P -> Q |
| 1021 | S -> T |
| 1117 | V -> M |
| 1193 | Q -> L |
| 1231 | K -> T |
| 1251 | A -> T |

Protein Mucin 1 Precursor (SEQ ID NO:398) Localization is Believed to be Type I Membrane Protein. Two Secreted Forms (5 and 9) are Also Produced.

The previously known protein also has the following indication(s) and/or potential therapeutic use(s): Cancer, breast; Cancer, lung, non-small cell; Cancer, ovarian; Cancer, prostate; Cancer. It has been investigated for clinical/therapeutic use in humans, for example as a target for an antibody or small molecule, and/or as a direct therapeutic; available information related to these investigations is as follows. Potential pharmaceutically related or therapeutically related activity or activities of the previously known protein are as follows: CD8 agonist; DNA antagonist; Immunostimulant; Interferon gamma agonist; MUC-1 inhibitor. A therapeutic role for a protein represented by the cluster has been predicted. The cluster was assigned this field because there was information in the drug database or the public databases (e.g., described herein above) that this protein, or part thereof, is used or can be used for a potential therapeutic indication: Anticancer; Monoclonal antibody, murine; Immunotoxin; Immunostimulant; Immunoconjugate.

The following GO Annotation(s) apply to the previously known protein. The following annotation(s) were found: actin binding, which are annotation(s) related to Molecular Function; and cytoskeleton; integral plasma membrane protein, which are annotation(s) related to Cellular Component.

The GO assignment relies on information from one or more of the SwissProt/TremB1 Protein knowledgebase, available from expasydot ch/sprot/; or Locuslink, available from ncbidot nlmdot nihdot gov/projects/LocusLink/.

Cluster HSMUC1A can be used as a diagnostic marker according to overexpression of transcripts of this cluster in cancer. Expression of such transcripts in normal tissues is also given according to the previously described methods. The term "number" in the left hand column of the table and the numbers on the y-axis of FIG. 17 refer to weighted expression of ESTs in each category, as "parts per million" (ratio of the expression of ESTs for a particular cluster to the expression of all ESTs in that category, according to parts per million).

Overall, the following results were obtained as shown with regard to the histograms in FIG. 17 and Table 416. This cluster is overexpressed (at least at a minimum level) in the following pathological conditions: a mixture of malignant tumors from different tissues, breast malignant tumors, pancreas carcinoma and prostate cancer.

TABLE 416

Normal tissue distribution

| Name of Tissue | Number |
|---|---|
| Bladder | 41 |
| Brain | 2 |
| Colon | 66 |
| Epithelial | 96 |
| General | 36 |
| head and neck | 314 |
| Kidney | 282 |
| Lung | 200 |
| Breast | 61 |
| Ovary | 0 |
| Pancreas | 12 |
| Prostate | 24 |
| Stomach | 296 |
| Thyroid | 0 |
| Uterus | 122 |

TABLE 417

P values and ratios for expression in cancerous tissue

| Name of Tissue | P1 | P2 | SP1 | R3 | SP2 | R4 |
|---|---|---|---|---|---|---|
| Bladder | 3.3e-01 | 4.5e-01 | 1.8e-02 | 2.4 | 8.9e-02 | 1.7 |
| Brain | 3.0e-02 | 2.6e-02 | 1.2e-01 | 4.6 | 1.1e-01 | 3.9 |
| Colon | 1.2e-01 | 2.4e-01 | 3.8e-01 | 1.6 | 5.9e-01 | 1.2 |
| epithelial | 5.4e-02 | 6.0e-01 | 7.3e-06 | 1.8 | 6.2e-02 | 1.1 |
| General | 6.5e-07 | 2.6e-03 | 4.0e-23 | 3.6 | 1.7e-12 | 2.3 |
| head and neck | 6.4e-01 | 7.2e-01 | 1 | 0.3 | 1 | 0.3 |
| Kidney | 7.8e-01 | 8.1e-01 | 1 | 0.3 | 1 | 0.2 |
| Lung | 7.6e-01 | 7.9e-01 | 6.7e-01 | 0.8 | 1 | 0.4 |
| Breast | 8.2e-02 | 1.3e-01 | 4.1e-03 | 3.6 | 7.7e-02 | 2.0 |
| Ovary | 3.0e-02 | 4.3e-02 | 6.9e-02 | 4.4 | 1.6e-01 | 3.2 |
| Pancreas | 7.2e-02 | 1.4e-01 | 9.6e-07 | 5.4 | 1.5e-05 | 4.5 |
| Prostate | 7.0e-01 | 6.0e-01 | 1.5e-02 | 1.4 | 6.9e-04 | 3.2 |
| Stomach | 3.1e-01 | 7.1e-01 | 1.5e-01 | 0.4 | 4.6e-01 | 0.8 |
| Thyroid | 2.9e-01 | 2.9e-01 | 4.4e-01 | 2.0 | 4.4e-01 | 2.0 |
| Uterus | 2.4e-01 | 6.5e-01 | 1.6e-01 | 1.0 | 7.0e-01 | 0.6 |

As noted above, cluster HSMUC1A features 14 transcript(s), which were listed in Table 1 above. These transcript(s) encode for protein(s) which are variant(s) of protein Mucin 1 precursor (SEQ ID NO:398). A description of each variant protein according to the present invention is now provided.

Variant protein HSMUC1A_PEA_1_P25 (SEQ ID NO:370) according to the present invention has an amino acid sequence as given at the end of the application; it is encoded by transcript(s) HSMUC1A_PEA_1_T26 (SEQ ID NO:47). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide.

Variant protein HSMUC1A_PEA_1_P25 (SEQ ID NO:370) also has the following non-silent SNPs (Single Nucleotide Polymorphisms) as listed in Table 418, (given according to their position(s) on the amino acid sequence, with the alternative amino acid(s) listed; the last column indicates whether the SNP is known or not; the presence of known SNPs in variant protein HSMUC1A_PEA_1_P25 (SEQ ID NO:370) sequence provides support for the deduced sequence of this variant protein according to the present invention).

TABLE 418

Amino acid mutations

| SNP position(s) on amino acid sequence | Alternative amino acid(s) | Previously known SNP? |
|---|---|---|
| 90 | S -> N | Yes |
| 91 | D -> N | No |
| 157 | Y -> | No |
| 187 | S -> G | No |

Variant protein HSMUC1A_PEA_1_P25 (SEQ ID NO:370) is encoded by the following transcript(s): HSMUC1A_PEA_1_T26 (SEQ ID NO:47), for which the sequence(s) is/are given at the end of the application. The coding portion of transcript HSMUC1A_PEA_1_T26 (SEQ ID NO:47) is shown in bold; this coding portion starts at position 507 and ends at position 1115. The transcript also has the following SNPs as listed in Table 419 (given according to their position on the nucleotide sequence, with the alternative nucleic acid listed; the last column indicates whether the SNP is known or not; the presence of known SNPs in variant protein HSMUC1A_PEA_1_P25 (SEQ ID NO:370) sequence provides support for the deduced sequence of this variant protein according to the present invention).

TABLE 419

Nucleic acid SNPs

| SNP position on nucleotide sequence | Alternative nucleic acid | Previously known SNP? |
|---|---|---|
| 572 | A -> G | No |
| 775 | G -> A | Yes |
| 777 | G -> A | No |
| 977 | C -> | No |
| 1065 | A -> G | No |
| 1073 | C -> T | No |
| 1079 | C -> T | Yes |
| 1124 | C -> T | Yes |
| 1177 | C -> T | No |
| 1197 | C -> T | Yes |
| 1303 | G -> | No |
| 1315 | G -> A | Yes |
| 1316 | C -> | No |
| 1316 | C -> T | No |
| 1405 | A -> T | No |

Variant protein HSMUC1A_PEA_1_P29 (SEQ ID NO:371) according to the present invention has an amino acid sequence as given at the end of the application; it is encoded by transcript(s) HSMUC1A_PEA_1_T33 (SEQ ID NO:52). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P29 (SEQ ID NO:371) is encoded by the following transcript(s): HSMUC1A_PEA_1_T33 (SEQ ID NO:52), for which the sequence(s) is/are given at the end of the application. The coding portion of transcript HSMUC1A_PEA_1_T33 (SEQ ID NO:52) is shown in bold; this coding portion starts at position 507 and ends at position 953. The transcript also has the following SNPs as listed in Table 420 (given according to their position on the nucleotide sequence, with the alternative nucleic acid listed; the last column indicates whether the SNP is known or not; the presence of known SNPs in variant protein HSMUC1A_PEA_1_P29 (SEQ ID NO:371) sequence provides support for the deduced sequence of this variant protein according to the present invention).

TABLE 420

Nucleic acid SNPs

| SNP position on nucleotide sequence | Alternative nucleic acid | Previously known SNP? |
|---|---|---|
| 572 | A -> G | No |
| 964 | C -> | No |
| 1052 | A -> G | No |
| 1060 | C -> T | No |
| 1066 | C -> T | Yes |
| 1111 | C -> T | Yes |
| 1164 | C -> T | No |
| 1184 | C -> T | Yes |
| 1290 | G -> | No |
| 1302 | G -> A | Yes |
| 1303 | C -> | No |
| 1303 | C -> T | No |
| 1392 | A -> T | No |

Variant protein HSMUC1A_PEA_1_P30 (SEQ ID NO:372) according to the present invention has an amino acid sequence as given at the end of the application; it is encoded by transcript(s) HSMUC1A_PEA_1_T34 (SEQ ID NO:53). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide.

Variant protein HSMUC1A_PEA_1_P30 (SEQ ID NO:372) also has the following non-silent SNPs (Single Nucleotide Polymorphisms) as listed in Table 421, (given according to their position(s) on the amino acid sequence, with the alternative amino acid(s) listed; the last column indicates whether the SNP is known or not; the presence of known SNPs in variant protein HSMUC1A_PEA_1_P30 (SEQ ID NO:372) sequence provides support for the deduced sequence of this variant protein according to the present invention).

TABLE 421

Amino acid mutations

| SNP position(s) on amino acid sequence | Alternative amino acid(s) | Previously known SNP? |
|---|---|---|
| 120 | Y -> | No |
| 150 | S -> G | No |

Variant protein HSMUC1A_PEA_1_P30 (SEQ ID NO:372) is encoded by the following transcript(s): HSMUC1A_PEA_1_T34 (SEQ ID NO:53), for which the sequence(s) is/are given at the end of the application. The coding portion of transcript HSMUC1A_PEA_1_T34 (SEQ ID NO:53) is shown in bold; this coding portion starts at position 507 and ends at position 1004. The transcript also has the following SNPs as listed in Table 422 (given according to their position on the nucleotide sequence, with the alternative nucleic acid listed; the last column indicates whether the SNP is known or not; the presence of known SNPs in variant protein HSMUC1A_PEA_1_P30 (SEQ ID NO:372) sequence provides support for the deduced sequence of this variant protein according to the present invention).

TABLE 422

| | Nucleic acid SNPs | |
|---|---|---|
| SNP position on nucleotide sequence | Alternative nucleic acid | Previously known SNP? |
| 599 | A -> G | No |
| 866 | C -> | No |
| 954 | A -> G | No |
| 962 | C -> T | No |
| 968 | C -> T | Yes |
| 1013 | C -> T | Yes |
| 1066 | C -> T | No |
| 1086 | C -> T | Yes |
| 1192 | G -> | No |
| 1204 | G -> A | Yes |
| 1205 | C -> | No |
| 1205 | C -> T | No |
| 1294 | A -> T | No |

Variant protein HSMUC1A_PEA_1_P32 (SEQ ID NO:373) according to the present invention has an amino acid sequence as given at the end of the application; it is encoded by transcript(s) HSMUC1A_PEA_1_T36 (SEQ ID NO:55). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide.

Variant protein HSMUC1A_PEA_1_P32 (SEQ ID NO:373) also has the following non-silent SNPs (Single Nucleotide Polymorphisms) as listed in Table 423, (given according to their position(s) on the amino acid sequence, with the alternative amino acid(s) listed; the last column indicates whether the SNP is known or not; the presence of known SNPs in variant protein HSMUC1A_PEA_1_P32 (SEQ ID NO:373) sequence provides support for the deduced sequence of this variant protein according to the present invention).

TABLE 423

| | Amino acid mutations | |
|---|---|---|
| SNP position(s) on amino acid sequence | Alternative amino acid(s) | Previously known SNP? |
| 111 | Y -> | No |
| 141 | S -> G | No |

Variant protein HSMUC1A_PEA_1_P32 (SEQ ID NO:373) is encoded by the following transcript(s): HSMUC1A_PEA_1_T36 (SEQ ID NO:55), for which the sequence(s) is/are given at the end of the application. The coding portion of transcript HSMUC1A_PEA_1_T36 (SEQ ID NO:55) is shown in bold; this coding portion starts at position 507 and ends at position 977. The transcript also has the following SNPs as listed in Table 424 (given according to their position on the nucleotide sequence, with the alter-native nucleic acid listed; the last column indicates whether the SNP is known or not; the presence of known SNPs in variant protein HSMUC1A_PEA_1_P32 (SEQ ID NO:373) sequence provides support for the deduced sequence of this variant protein according to the present invention).

TABLE 424

| | Nucleic acid SNPs | |
|---|---|---|
| SNP position on nucleotide sequence | Alternative nucleic acid | Previously known SNP? |
| 572 | A -> G | No |
| 839 | C -> | No |
| 927 | A -> G | No |
| 935 | C -> T | No |
| 941 | C -> T | Yes |
| 986 | C -> T | Yes |
| 1039 | C -> T | No |
| 1059 | C -> T | Yes |
| 1165 | G -> | No |
| 1177 | G -> A | Yes |
| 1178 | C -> | No |
| 1178 | C -> T | No |
| 1267 | A -> T | No |

Variant protein HSMUC1A_PEA_1_P36 (SEQ ID NO:374) according to the present invention has an amino acid sequence as given at the end of the application; it is encoded by transcript(s) HSMUC1A_PEA_1_T40 (SEQ ID NO:56). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P36 (SEQ ID NO:374) also has the following non-silent SNPs (Single Nucleotide Polymorphisms) as listed in Table 425, (given according to their position(s) on the amino acid sequence, with the alternative amino acid(s) listed; the last column indicates whether the SNP is known or not; the presence of known SNPs in variant protein HSMUC1A_PEA_1_P36 (SEQ ID NO:374) sequence provides support for the deduced sequence of this variant protein according to the present invention).

TABLE 425

| | Amino acid mutations | |
|---|---|---|
| SNP position(s) on amino acid sequence | Alternative amino acid(s) | Previously known SNP? |
| 113 | Y -> | No |
| 143 | S -> G | No |

Variant protein HSMUC1A_PEA_1_P36 (SEQ ID NO:374) is encoded by the following transcript(s): HSMUC1A_PEA_1_T40 (SEQ ID NO:56), for which the sequence(s) is/are given at the end of the application. The coding portion of transcript HSMUC1A_PEA_1_T40 (SEQ ID NO:56) is shown in bold; this coding portion starts at position 507 and ends at position 983. The transcript also has the following SNPs as listed in Table 426 (given according to their position on the nucleotide sequence, with the alternative nucleic acid listed; the last column indicates whether the SNP is known or not; the presence of known SNPs in variant protein HSMUC1A_PEA_1_P36 (SEQ ID NO:374) sequence provides support for the deduced sequence of this variant protein according to the present invention).

TABLE 426

Nucleic acid SNPs

| SNP position on nucleotide sequence | Alternative nucleic acid | Previously known SNP? |
|---|---|---|
| 599 | A -> G | No |
| 845 | C -> | No |
| 933 | A -> G | No |
| 941 | C -> T | No |
| 947 | C -> T | Yes |
| 992 | C -> T | Yes |
| 1045 | C -> T | No |
| 1065 | C -> T | Yes |
| 1171 | G -> | No |
| 1183 | G -> A | Yes |
| 1184 | C -> | No |
| 1184 | C -> T | No |
| 1273 | A -> T | No |

Variant protein HSMUC1A_PEA_1_P39 (SEQ ID NO:375) according to the present invention has an amino acid sequence as given at the end of the application; it is encoded by transcript(s) HSMUC1A_PEA_1_T43 (SEQ ID NO:58). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P39 (SEQ ID NO:375) also has the following non-silent SNPs (Single Nucleotide Polymorphisms) as listed in Table 427, (given according to their position(s) on the amino acid sequence, with the alternative amino acid(s) listed; the last column indicates whether the SNP is known or not; the presence of known SNPs in variant protein HSMUC1A_PEA_1_P39 (SEQ ID NO:375) sequence provides support for the deduced sequence of this variant protein according to the present invention).

TABLE 427

Amino acid mutations

| SNP position(s) on amino acid sequence | Alternative amino acid(s) | Previously known SNP? |
|---|---|---|
| 90 | Y -> | No |
| 120 | S -> G | No |

Variant protein HSMUC1A_PEA_1_P39 (SEQ ID NO:375) is encoded by the following transcript(s): HSMUC1A_PEA_1_T43 (SEQ ID NO:58), for which the sequence(s) is/are given at the end of the application. The coding portion of transcript HSMUC1A_PEA_1_T43 (SEQ ID NO:58) is shown in bold; this coding portion starts at position 507 and ends at position 914. The transcript also has the following SNPs as listed in Table 428 (given according to their position on the nucleotide sequence, with the alternative nucleic acid listed; the last column indicates whether the SNP is known or not; the presence of known SNPs in variant protein HSMUC1A_PEA_1_P39 (SEQ ID NO:375) sequence provides support for the deduced sequence of this variant protein according to the present invention).

TABLE 428

Nucleic acid SNPs

| SNP position on nucleotide sequence | Alternative nucleic acid | Previously known SNP? |
|---|---|---|
| 599 | A -> G | No |
| 776 | C -> | No |
| 864 | A -> G | No |
| 872 | C -> T | No |
| 878 | C -> T | Yes |
| 923 | C -> T | Yes |
| 976 | C -> T | No |
| 996 | C -> T | Yes |
| 1102 | G -> | No |
| 1114 | G -> A | Yes |
| 1115 | C -> | No |
| 1115 | C -> T | No |
| 1204 | A -> T | No |

Variant protein HSMUC1A_PEA_1_P45 (SEQ ID NO:376) according to the present invention has an amino acid sequence as given at the end of the application; it is encoded by transcript(s) HSMUC1A_PEA_1_T29 (SEQ ID NO:49). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P45 (SEQ ID NO:376) is encoded by the following transcript(s): HSMUC1A_PEA_1_T29 (SEQ ID NO:49), for which the sequence(s) is/are given at the end of the application. The coding portion of transcript HSMUC1A_PEA_1_T29 (SEQ ID NO:49) is shown in bold; this coding portion starts at position 507 and ends at position 746. The transcript also has the following SNPs as listed in Table 429 (given according to their position on the nucleotide sequence, with the alternative nucleic acid listed; the last column indicates whether the SNP is known or not; the presence of known SNPs in variant protein HSMUC1A_PEA_1_P45 (SEQ ID NO:376) sequence provides support for the deduced sequence of this variant protein according to the present invention).

TABLE 429

Nucleic acid SNPs

| SNP position on nucleotide sequence | Alternative nucleic acid | Previously known SNP? |
|---|---|---|
| 599 | A -> G | No |
| 746 | G -> A | Yes |
| 748 | G -> A | No |
| 948 | C -> | No |
| 1036 | A -> G | No |
| 1044 | C -> T | No |
| 1050 | C -> T | Yes |
| 1095 | C -> T | Yes |
| 1148 | C -> T | No |

TABLE 429-continued

Nucleic acid SNPs

| SNP position on nucleotide sequence | Alternative nucleic acid | Previously known SNP? |
| --- | --- | --- |
| 1168 | C -> T | Yes |
| 1274 | G -> | No |
| 1286 | G -> A | Yes |
| 1287 | C -> | No |
| 1287 | C -> T | No |
| 1376 | A -> T | No |

Variant protein HSMUC1A_PEA_1_P49 (SEQ ID NO:377) according to the present invention has an amino acid sequence as given at the end of the application; it is encoded by transcript(s) HSMUC1A_PEA_1_T12 (SEQ ID NO:46). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P49 (SEQ ID NO:377) is encoded by the following transcript(s): HSMUC1A_PEA_1_T12 (SEQ ID NO:46), for which the sequence(s) is/are given at the end of the application. The coding portion of transcript HSMUC1 A_PEA_1_T12 (SEQ ID NO:46) is shown in bold; this coding portion starts at position 507 and ends at position 884. The transcript also has the following SNPs as listed in Table 430 (given according to their position on the nucleotide sequence, with the alternative nucleic acid listed; the last column indicates whether the SNP is known or not; the presence of known SNPs in variant protein HSMUC1A_PEA_1_P49 (SEQ ID NO:377) sequence provides support for the deduced sequence of this variant protein according to the present invention).

TABLE 430

Nucleic acid SNPs

| SNP position on nucleotide sequence | Alternative nucleic acid | Previously known SNP? |
| --- | --- | --- |
| 572 | A -> G | No |
| 704 | G -> A | Yes |
| 1012 | G -> A | Yes |
| 1088 | G -> A | Yes |
| 1090 | G -> A | No |
| 1290 | C -> | No |
| 1378 | A -> G | No |
| 1386 | C -> T | No |
| 1392 | C -> T | Yes |
| 1437 | C -> T | Yes |
| 1490 | C -> T | No |
| 1510 | C -> T | Yes |
| 1616 | G -> | No |
| 1628 | G -> A | Yes |
| 1629 | C -> | No |
| 1629 | C -> T | No |
| 1718 | A -> T | No |

Variant protein HSMUC1A_PEA_1_P52 (SEQ ID NO:378) according to the present invention has an amino acid sequence as given at the end of the application; it is encoded by transcript(s) HSMUC1A_PEA_1_T30 (SEQ ID NO:50). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P52 (SEQ ID NO:378) is encoded by the following transcript(s): HSMUC1A_PEA_1_T30 (SEQ ID NO:50), for which the sequence(s) is/are given at the end of the application. The coding portion of transcript HSMUC1A_PEA_1_T30 (SEQ ID NO:50) is shown in bold; this coding portion starts at position 507 and ends at position 719. The transcript also has the following SNPs as listed in Table 431 (given according to their position on the nucleotide sequence, with the alternative nucleic acid listed; the last column indicates whether the SNP is known or not; the presence of known SNPs in variant protein HSMUC1A_PEA_1_P52 (SEQ ID NO:378) sequence provides support for the deduced sequence of this variant protein according to the present invention).

TABLE 431

Nucleic acid SNPs

| SNP position on nucleotide sequence | Alternative nucleic acid | Previously known SNP? |
| --- | --- | --- |
| 572 | A -> G | No |
| 719 | G -> A | Yes |
| 721 | G -> A | No |
| 921 | C -> | No |
| 1009 | A -> G | No |
| 1017 | C -> T | No |
| 1023 | C -> T | Yes |
| 1068 | C -> T | Yes |
| 1121 | C -> T | No |
| 1141 | C -> T | Yes |
| 1247 | G -> | No |
| 1259 | G -> A | Yes |
| 1260 | C -> | No |
| 1260 | C -> T | No |
| 1349 | A -> T | No |

Variant protein HSMUC1A_PEA_1_P53 (SEQ ID NO:379) according to the present invention has an amino acid sequence as given at the end of the application; it is encoded by transcript(s) HSMUC 1 A_PEA_1_T31 (SEQ ID NO:51). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P53 (SEQ ID NO:379) is encoded by the following transcript(s): HSMUC1A_PEA_1_T31 (SEQ ID NO:51), for which the sequence(s) is/are given at the end of the application. The coding portion of transcript HSMUC1A_PEA_1_T31 (SEQ ID NO:51) is shown in bold; this coding portion starts at position 507 and ends at position 665. The transcript also has the following SNPs as listed in Table 432 (given according to their position on the nucleotide sequence, with the alternative nucleic acid listed; the last column indicates whether the SNP is known or not; the presence of known SNPs in variant protein HSMUC1A_PEA_1_P53 (SEQ ID NO:379) sequence provides support for the deduced sequence of this variant protein according to the present invention).

TABLE 432

Nucleic acid SNPs

| SNP position on nucleotide sequence | Alternative nucleic acid | Previously known SNP? |
|---|---|---|
| 572 | A -> G | No |
| 669 | G -> A | Yes |
| 671 | G -> A | No |
| 871 | C -> | No |
| 959 | A -> G | No |
| 967 | C -> T | No |
| 973 | C -> T | Yes |
| 1018 | C -> T | Yes |
| 1071 | C -> T | No |
| 1091 | C -> T | Yes |
| 1197 | G -> | No |
| 1209 | G -> A | Yes |
| 1210 | C -> | No |
| 1210 | C -> T | No |
| 1299 | A -> T | No |

Variant protein HSMUC1A_PEA_1_P56 (SEQ ID NO:380) according to the present invention has an amino acid sequence as given at the end of the application; it is encoded by transcript(s) HSMUC1A_PEA_1_T42 (SEQ ID NO:57). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P56 (SEQ ID NO:380) also has the following non-silent SNPs (Single Nucleotide Polymorphisms) as listed in Table 433, (given according to their position(s) on the amino acid sequence, with the alternative amino acid(s) listed; the last column indicates whether the SNP is known or not; the presence of known SNPs in variant protein HSMUC1A_PEA_1_P56 (SEQ ID NO:380) sequence provides support for the deduced sequence of this variant protein according to the present invention).

TABLE 433

Amino acid mutations

| SNP position(s) on amino acid sequence | Alternative amino acid(s) | Previously known SNP? |
|---|---|---|
| 117 | P -> | No |

Variant protein HSMUC1A_PEA_1_P56 (SEQ ID NO:380) is encoded by the following transcript(s): HSMUC1A_PEA_1_T42 (SEQ ID NO:57), for which the sequence(s) is/are given at the end of the application. The coding portion of transcript HSMUC1A_PEA_1_T42 (SEQ ID NO:57) is shown in bold; this coding portion starts at position 507 and ends at position 890. The transcript also has the following SNPs as listed in Table 434 (given according to their position on the nucleotide sequence, with the alternative nucleic acid listed; the last column es whether the SNP is known or not; the presence of known SNPs in variant protein HSMUC1A_PEA_1_P56 (SEQ ID NO:380) sequence provides support for the deduced sequence of this variant protein according to the present invention).

TABLE 434

Nucleic acid SNPs

| SNP position on nucleotide sequence | Alternative nucleic acid | Previously known SNP? |
|---|---|---|
| 572 | A -> G | No |
| 855 | C -> | No |
| 943 | A -> G | No |
| 951 | C -> T | No |
| 957 | C -> T | Yes |
| 1002 | C -> T | Yes |
| 1055 | C -> T | No |
| 1075 | C -> T | Yes |
| 1181 | G -> | No |
| 1193 | G -> A | Yes |
| 1194 | C -> | No |
| 1194 | C -> T | No |
| 1283 | A -> T | No |

Variant protein HSMUC1A_PEA_1_P58 (SEQ ID NO:381) according to the present invention has an amino acid sequence as given at the end of the application; it is encoded by transcript(s) HSMUC1A_PEA_1_T35 (SEQ ID NO:54). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P58 (SEQ ID NO:381) also has the following non-silent SNPs (Single Nucleotide Polymorphisms) as listed in Table 435, (given according to their position(s) on the amino acid sequence, with the alternative amino acid(s) listed; the last column indicates whether the SNP is known or not; the presence of known SNPs in variant protein HSMUC1A_PEA_1_P58 (SEQ ID NO:381) sequence provides support for the deduced sequence of this variant protein according to the present invention).

TABLE 435

Amino acid mutations

| SNP position(s) on amino acid sequence | Alternative amino acid(s) | Previously known SNP? |
|---|---|---|
| 147 | P -> | No |

Variant protein HSMUC1A_PEA_1_P58 (SEQ ID NO:381) is encoded by the following transcript(s): HSMUC1A_PEA_1_T35 (SEQ ID NO:54), for which the sequence(s) is/are given at the end of the application. The coding portion of transcript HSMUC1A_PEA_1_T35 (SEQ ID NO:54) is shown in bold; this coding portion starts at position 507 and ends at position 980. The transcript also has the following SNPs as listed in Table 436 (given according to their position on the nucleotide sequence, with the alternative nucleic acid listed; the last column indicates whether the SNP is known or not; the presence of known SNPs in variant protein HSMUC1A_PEA_1_P58 (SEQ ID NO:381) sequence provides support for the deduced sequence of this variant protein according to the present invention).

TABLE 436

Nucleic acid SNPs

| SNP position on nucleotide sequence | Alternative nucleic acid | Previously known SNP? |
|---|---|---|
| 572 | A -> G | No |
| 945 | C -> | No |
| 1033 | A -> G | No |
| 1041 | C -> T | No |
| 1047 | C -> T | Yes |
| 1092 | C -> T | Yes |
| 1145 | C -> T | No |
| 1165 | C -> T | Yes |
| 1271 | G -> | No |
| 1283 | G -> A | Yes |
| 1284 | C -> | No |
| 1284 | C -> T | No |
| 1373 | A -> T | No |

Variant protein HSMUC1A_PEA_1_P59 (SEQ ID NO:382) according to the present invention has an amino acid sequence as given at the end of the application; it is encoded by transcript(s) HSMUC1A_PEA_1_T28 (SEQ ID NO:48). The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

Variant protein HSMUC1A_PEA_1_P59 (SEQ ID NO:382) is encoded by the following transcript(s): HSMUC1A_PEA_1_T28 (SEQ ID NO:48), for which the sequence(s) is/are given at the end of the application. The coding portion of transcript HSMUC1A_PEA_1_T28 (SEQ ID NO:48) is shown in bold; this coding portion starts at position 507 and ends at position 794. The transcript also has the following SNPs as listed in Table 437 (given according to their position on the nucleotide sequence, with the alternative nucleic acid listed; the last column indicates whether the SNP is known or not; the presence of known SNPs in variant protein HSMUC1A_PEA_1_P59 (SEQ ID NO:382) sequence provides support for the deduced sequence of this variant protein according to the present invention).

TABLE 437

Nucleic acid SNPs

| SNP position on nucleotide sequence | Alternative nucleic acid | Previously known SNP? |
|---|---|---|
| 572 | A -> G | No |
| 794 | G -> A | Yes |
| 796 | G -> A | No |
| 996 | C -> | No |
| 1084 | A -> G | No |
| 1092 | C -> T | No |
| 1098 | C -> T | Yes |

TABLE 437-continued

Nucleic acid SNPs

| SNP position on nucleotide sequence | Alternative nucleic acid | Previously known SNP? |
|---|---|---|
| 1143 | C -> T | Yes |
| 1196 | C -> T | No |
| 1216 | C -> T | Yes |
| 1322 | G -> | No |
| 1334 | G -> A | Yes |
| 1335 | C -> | No |
| 1335 | C -> T | No |
| 1424 | A -> T | No |

Variant protein HSMUC1A_PEA_1_P63 (SEQ ID NO:383) according to the present invention has an amino acid sequence as given at the end of the application; it is encoded by transcript(s) HSMUC1A_PEA_1_T47 (SEQ ID NO:59). An alignment is given to the known protein (Mucin 1 precursor (SEQ ID NO:398)) at the end of the application. One or more alignments to one or more previously published protein sequences are given at the end of the application. A brief description of the relationship of the variant protein according to the present invention to each such aligned protein is as follows:

Comparison report between HSMUC1A_PEA_1_P63 (SEQ ID NO:383) and MUC1_HUMAN:

1. An isolated chimeric polypeptide encoding for HSMUC1A_PEA_1_P63 (SEQ ID NO:383), comprising a first amino acid sequence being at least 90% homologous to MTPGTQSPFFLLLLLTVLTVVTGSGHAS-STPGGEKETSATQRSSV corresponding to amino acids 1-45 of MUC1_HUMAN, which also corresponds to amino acids 1-45 of HSMUC1A_PEA_1_P63 (SEQ ID NO:383), and a second amino acid sequence being at least 70%, optionally at least 80%, preferably at least 85%, more preferably at least 90% and most preferably at least 95% homologous to a polypeptide having the sequence EEEVSADQVSVGASGVLGSFKEARNAPS-FLSWSFSMGPSK (SEQ ID NO: 575) corresponding to amino acids 46-85 of HSMUC1A_PEA_1_P63 (SEQ ID NO:383), wherein said first amino acid sequence and second amino acid sequence are contiguous and in a sequential order.

2. An isolated polypeptide encoding for a tail of HSMUC1A_PEA_1_P63 (SEQ ID NO:383), comprising a polypeptide being at least 70%, optionally at least about 80%, preferably at least about 85%, more preferably at least about 90% and most preferably at least about 95% homologous to the sequence EEEVSADQVSVGASGVLGS-FKEARNAPSFLSWSFSMGPSK (SEQ ID NO: 575) in HSMUC1A_PEA_1_P63 (SEQ ID NO:383).

The location of the variant protein was determined according to results from a number of different software programs and analyses, including analyses from SignalP and other specialized programs. The variant protein is believed to be located as follows with regard to the cell: secreted. The protein localization is believed to be secreted because both signal-peptide prediction programs predict that this protein has a signal peptide, and neither trans-membrane region prediction program predicts that this protein has a trans-membrane region.

The glycosylation sites of variant protein HSMUC1A_PEA_1_P63 (SEQ ID NO:383), as compared to the known protein Mucin 1 precursor (SEQ ID NO:398), are described in Table 438 (given according to their position (s) on the amino acid sequence in the first column; the second column indicates whether the glycosylation site is present in the variant protein; and the last column indicates whether the position is different on the variant protein).

TABLE 438

Glycosylation site(s)

| Position(s) on known amino acid sequence | Present in variant protein? |
|---|---|
| 1055 | No |
| 957 | No |
| 975 | No |
| 1133 | No |
| 1029 | No |

Variant protein HSMUC1A_PEA_1_P63 (SEQ ID NO:383) is encoded by the following transcript(s): HSMUC1A_PEA_1_T47 (SEQ ID NO:59), for which the sequence(s) is/are given at the end of the application. The coding portion of transcript HSMUC1A_PEA_1_T47 (SEQ ID NO:59) is shown in bold; this coding portion starts at position 507 and ends at position 761. The transcript also has the following SNPs as listed in Table 439 (given according to their position on the nucleotide sequence, with the alternative nucleic acid listed; the last column indicates whether the SNP is known or not; the presence of known SNPs in variant protein HSMUC1A_PEA_1_P63 (SEQ ID NO:383) sequence provides support for the deduced sequence of this variant protein according to the present invention).

TABLE 439

Nucleic acid SNPs

| SNP position on nucleotide sequence | Alternative nucleic acid | Previously known SNP? |
|---|---|---|
| 572 | A -> G | No |
| 900 | A -> | No |
| 904 | C -> | No |
| 963 | A -> C | Yes |
| 1211 | A -> G | No |
| 1219 | C -> T | No |
| 1225 | C -> T | Yes |
| 1270 | C -> T | Yes |
| 1323 | C -> T | No |
| 1343 | C -> T | Yes |
| 1449 | G -> | No |
| 1461 | G -> A | Yes |
| 1462 | C -> | No |
| 1462 | C -> T | No |
| 1551 | A -> T | No |

As noted above, cluster HSMUC1A features 22 segment(s), which were listed in Table 2 above and for which the sequence(s) are given at the end of the application. These segment(s) are portions of nucleic acid sequence(s) which are described herein separately because they are of particular interest. A description of each segment according to the present invention is now provided.

Segment cluster HSMUC1A_PEA_1_node_0 (SEQ ID NO:305) according to the present invention is supported by 31 libraries. The number of libraries was determined as previously described. This segment can be found in the following transcript(s): HSMUC1A_PEA_1_T12 SEQ ID NO:46), HSMUC1A_PEA_1_T26 (SEQ ID NO:47), HSMUC1A_PEA_1_T28 (SEQ ID NO:48), HSMUC1A_PEA_1_T29 (SEQ ID NO:49), HSMUC1A_PEA_1_T30 (SEQ ID NO:50), HSMUC1A_PEA_1_T31 (SEQ ID NO:51), HSMUC1A_PEA_1_T33 (SEQ ID NO:52), HSMUC1A_PEA_1_T34 (SEQ ID NO:53), HSMUC1A_PEA_1_T35 (SEQ ID NO:54), HSMUC1A_PEA_1_T36 (SEQ ID NO:55), HSMUC1A_PEA_1_T40 (SEQ ID NO:56), HSMUC1A_PEA_1_T42 (SEQ ID NO:57), HSMUC1A_PEA_1_T43 (SEQ ID NO:58) and HSMUC1A_PEA_1_T47 (SEQ ID NO:59). Table 440 below describes the starting and ending position of this segment on each transcript.

TABLE 440

Segment location on transcripts

| Transcript name | Segment starting position | Segment ending position |
|---|---|---|
| HSMUC1A_PEA_1_T12 (SEQ ID NO:46) | 1 | 564 |
| HSMUC1A_PEA_1_T26 (SEQ ID NO:47) | 1 | 564 |
| HSMUC1A_PEA_1_T28 (SEQ ID NO:48) | 1 | 564 |
| HSMUC1A_PEA_1_T29 (SEQ ID NO:49) | 1 | 564 |
| HSMUC1A_PEA_1_T30 (SEQ ID NO:50) | 1 | 564 |
| HSMUC1A_PEA_1_T31 (SEQ ID NO:51) | 1 | 564 |
| HSMUC1A_PEA_1_T33 (SEQ ID NO:52) | 1 | 564 |
| HSMUC1A_PEA_1_T34 (SEQ ID NO:53) | 1 | 564 |
| HSMUC1A_PEA_1_T35 (SEQ ID NO:54) | 1 | 564 |
| HSMUC1A_PEA_1_T36 (SEQ ID NO:55) | 1 | 564 |
| HSMUC1A_PEA_1_T40 (SEQ ID NO:56) | 1 | 564 |
| HSMUC1A_PEA_1_T42 (SEQ ID NO:57) | 1 | 564 |
| HSMUC1A_PEA_1_T43 (SEQ ID NO:58) | 1 | 564 |
| HSMUC1A_PEA_1_T47 (SEQ ID NO:59) | 1 | 564 |

Segment cluster HSMUC1A_PEA_1_node_14 (SEQ ID NO:306) according to the present invention is supported by 55 libraries. The number of libraries was determined as previously described. This segment can be found in the following transcript(s): HSMUC1A_PEA_1_T12 (SEQ ID NO:46). Table 441 below describes the starting and ending position of this segment on each transcript.

TABLE 441

Segment location on transcripts

| Transcript name | Segment starting position | Segment ending position |
|---|---|---|
| HSMUC1A_PEA_1_T12 (SEQ ID NO:46) | 666 | 841 |

Segment cluster HSMUC1A_PEA_1_node_24 (SEQ ID NO:307) according to the present invention is supported by 135 libraries. The number of libraries was determined as previously described. This segment can be found in the following transcript(s): HSMUC1A_PEA_1_T12 (SEQ ID NO:46). Table 442 below describes the starting and ending position of this segment on each transcript.

TABLE 442

| | Segment location on transcripts | |
|---|---|---|
| Transcript name | Segment starting position | Segment ending position |
| HSMUC1A_PEA_1_T12 (SEQ ID NO:46) | 953 | 1084 |

Segment cluster HSMUC1A_PEA_1_node_29 (SEQ ID NO:308) according to the present invention is supported by 156 libraries. The number of libraries was determined as previously described. This segment can be found in the following transcript(s): HSMUC1A_PEA_1_T12 (SEQ ID NO:46), HSMUC1A_PEA_1_T26 (SEQ ID NO:47), HSMUC1A_PEA_1_T28 (SEQ ID NO:48), HSMUC1A_PEA_1_T29 (SEQ ID NO:49), HSMUC1A_PEA_1_T30 (SEQ ID NO:50), HSMUC1A_PEA_1_T31 (SEQ ID NO:51), HSMUC1A_PEA_1_T33 (SEQ ID NO:52), HSMUC1A_PEA_1_T34 (SEQ ID NO:53), HSMUC1A_PEA_1_T35 (SEQ ID NO:54), HSMUC1A_PEA_1_T36 (SEQ ID NO:55), HSMUC1A_PEA_1_T40 (SEQ ID NO:56), HSMUC1A_PEA_1_T42 (SEQ ID NO:57), and HSMUC1A_PEA_1_T43 (SEQ ID NO:58). Table 443 below describes the starting and ending position of this segment on each transcript.

TABLE 443

| | Segment location on transcripts | |
|---|---|---|
| Transcript name | Segment starting position | Segment ending position |
| HSMUC1A_PEA_1_T12 (SEQ ID NO:46) | 1207 | 1346 |
| HSMUC1A_PEA_1_T26 (SEQ ID NO:47) | 894 | 1033 |
| HSMUC1A_PEA_1_T28 (SEQ ID NO:48) | 913 | 1052 |
| HSMUC1A_PEA_1_T29 (SEQ ID NO:49) | 865 | 1004 |
| HSMUC1A_PEA_1_T30 (SEQ ID NO:50) | 838 | 977 |
| HSMUC1A_PEA_1_T31 (SEQ ID NO:51) | 788 | 927 |
| HSMUC1A_PEA_1_T33 (SEQ ID NO:52) | 881 | 1020 |
| HSMUC1A_PEA_1_T34 (SEQ ID NO:53) | 783 | 922 |
| HSMUC1A_PEA_1_T35 (SEQ ID NO:54) | 862 | 1001 |
| HSMUC1A_PEA_1_T36 (SEQ ID NO:55) | 756 | 895 |
| HSMUC1A_PEA_1_T40 (SEQ ID NO:56) | 762 | 901 |
| HSMUC1A_PEA_1_T42 (SEQ ID NO:57) | 772 | 911 |
| HSMUC1A_PEA_1_T43 (SEQ ID NO:58) | 693 | 832 |

Segment cluster HSMUC1A_PEA_1_node_35 (SEQ ID NO:309) according to the present invention is supported by 51 libraries. The number of libraries was determined as previously described. This segment can be found in the following transcript(s): HSMUC1A_PEA_1_T47 (SEQ ID NO:59). Table 444 below describes the starting and ending position of this segment on each transcript.

TABLE 444

| | Segment location on transcripts | |
|---|---|---|
| Transcript name | Segment starting position | Segment ending position |
| HSMUC1A_PEA_1_T47 (SEQ ID NO:59) | 666 | 1189 |

Segment cluster HSMUC1A_PEA_1_node_38 (SEQ ID NO:310) according to the present invention is supported by 140 libraries. The number of libraries was determined as previously described. This segment can be found in the following transcript(s): HSMUC1A_PEA_1_T12 (SEQ ID NO:46), HSMUC1A_PEA_1_T26 (SEQ ID NO:47), HSMUC1A_PEA_1_T28 (SEQ ID NO:48), HSMUC1A_PEA_1_T29 (SEQ ID NO:49), HSMUC1A_PEA_1_T30 (SEQ ID NO:50), HSMUC1A_PEA_1_T31 (SEQ ID NO:51), HSMUC1A_PEA_1_T33 (SEQ ID NO:52), HSMUC1A_PEA_1_T34 (SEQ ID NO:53), HSMUC1A_PEA_1_T35 (SEQ ID NO:54), HSMUC1A_PEA_1_T36 (SEQ ID NO:55), HSMUC1A_PEA_1_T40 (SEQ ID NO:56), HSMUC1A_PEA_1_T42 (SEQ ID NO:57), HSMUC1A_PEA_1_T43 (SEQ ID NO:58) and HSMUC1A_PEA_1_T47 (SEQ ID NO:59). Table 446 below describes the starting and ending position of this segment on each transcript.

TABLE 446

| | Segment location on transcripts | |
|---|---|---|
| Transcript name | Segment starting position | Segment ending position |
| HSMUC1A_PEA_1_T12 (SEQ ID NO:46) | 1488 | 1749 |
| HSMUC1A_PEA_1_T26 (SEQ ID NO:47) | 1175 | 1436 |
| HSMUC1A_PEA_1_T28 (SEQ ID NO:48) | 1194 | 1455 |
| HSMUC1A_PEA_1_T29 (SEQ ID NO:49) | 1146 | 1407 |
| HSMUC1A_PEA_1_T30 (SEQ ID NO:50) | 1119 | 1380 |
| HSMUC1A_PEA_1_T31 (SEQ ID NO:51) | 1069 | 1330 |
| HSMUC1A_PEA_1_T33 (SEQ ID NO:52) | 1162 | 1423 |
| HSMUC1A_PEA_1_T34 (SEQ ID NO:53) | 1064 | 1325 |
| HSMUC1A_PEA_1_T35 (SEQ ID NO:54) | 1143 | 1404 |
| HSMUC1A_PEA_1_T36 (SEQ ID NO:55) | 1037 | 1298 |
| HSMUC1A_PEA_1_T40 (SEQ ID NO:56) | 1043 | 1304 |
| HSMUC1A_PEA_1_T42 (SEQ ID NO:57) | 1053 | 1314 |
| HSMUC1A_PEA_1_T43 (SEQ ID NO:58) | 974 | 1235 |
| HSMUC1A_PEA_1_T47 (SEQ ID NO:59) | 1321 | 1582 |

According to an optional embodiment of the present invention, short segments related to the above cluster are also provided. These segments are up to about 120 bp in length, and so are included in a separate description.

Segment cluster HSMUC1A_PEA_1_node_3 (SEQ ID NO:311) according to the present invention is supported by 17 libraries. The number of libraries was determined as previously described. This segment can be found in the following transcript(s): HSMUC1A_PEA_1_T29 (SEQ ID NO:49), HSMUC1A_PEA_1_T34 (SEQ ID NO:53), HSMUC1A_PEA_1_T40 (SEQ ID NO:56) and HSMUC1A_PEA_1_T43 (SEQ ID NO:58). Table 447 below describes the starting and ending position of this segment on each transcript.

TABLE 447

Segment location on transcripts

| Transcript name | Segment starting position | Segment ending position |
|---|---|---|
| HSMUC1A_PEA_1_T29 (SEQ ID NO:49) | 565 | 591 |
| HSMUC1A_PEA_1_T34 (SEQ ID NO:53) | 565 | 591 |
| HSMUC1A_PEA_1_T40 (SEQ ID NO:56) | 565 | 591 |
| HSMUC1A_PEA_1_T43 (SEQ ID NO:58) | 565 | 591 |

Segment cluster HSMUC1A_PEA_1_node_4 (SE ID NO:312) according to the present invention can be found in the following transcript(s): HSMUC1A_PEA_1_T12 (SEQ ID NO:46), HSMUC1A_PEA_1_T26 (SEQ ID NO:47), HSMUC1A_PEA_1_T28 (SEQ ID NO:48), HSMUC1A_PEA_1_T29 (SEQ ID NO:49), HSMUC1A_PEA_1_T30 (SEQ ID NO:50), HSMUC1A_PEA_1_T31 (SEQ ID NO:51), HSMUC1A_PEA_1_T33 (SEQ ID NO:52), HSMUC1A_PEA_1_T34 (SEQ ID NO:53), HSMUC1A_PEA_1_T35 (SEQ ID NO:54), HSMUC1A_PEA_1_T36 (SEQ ID NO:55), HSMUC1A_PEA_1_T40 (SEQ ID NO:56), HSMUC1A_PEA_1_T42 (SEQ ID NO:57), HSMUC1A_PEA_1_T43 (SEQ ID NO:58) and HSMUC1A_PEA_1_T47 (SEQ ID NO:59). Table 448 below describes the starting and ending position of this segment on each transcript.

TABLE 448

Segment location on transcripts

| Transcript name | Segment starting position | Segment ending position |
|---|---|---|
| HSMUC1A_PEA_1_T12 (SEQ ID NO:46) | 565 | 573 |
| HSMUC1A_PEA_1_T26 (SEQ ID NO:47) | 565 | 573 |
| HSMUC1A_PEA_1_T28 (SEQ ID NO:48) | 565 | 573 |
| HSMUC1A_PEA_1_T29 (SEQ ID NO:49) | 592 | 600 |
| HSMUC1A_PEA_1_T30 (SEQ ID NO:50) | 565 | 573 |
| HSMUC1A_PEA_1_T31 (SEQ ID NO:51) | 565 | 573 |
| HSMUC1A_PEA_1_T33 (SEQ ID NO:52) | 565 | 573 |
| HSMUC1A_PEA_1_T34 (SEQ ID NO:53) | 592 | 600 |
| HSMUC1A_PEA_1_T35 (SEQ ID NO:54) | 565 | 573 |
| HSMUC1A_PEA_1_T36 (SEQ ID NO:55) | 565 | 573 |
| HSMUC1A_PEA_1_T40 (SEQ ID NO:56) | 592 | 600 |
| HSMUC1A_PEA_1_T42 (SEQ ID NO:57) | 565 | 573 |
| HSMUC1A_PEA_1_T43 (SEQ ID NO:58) | 592 | 600 |
| HSMUC1A_PEA_1_T47 (SEQ ID NO:59) | 565 | 573 |

Segment cluster HSMUC1A_PEA_1_node_5 (SEQ ID NO:313) according to the present invention is supported by 34 libraries. The number of libraries was determined as previously described. This segment can be found in the following transcript(s): HSMUC1A_PEA_1_T12 (SEQ ID NO:46), HSMUC1A_PEA_1_T26 (SEQ ID NO:47), HSMUC1A_PEA_1_T28 (SEQ ID NO:48), HSMUC1A_PEA_1_T29 (SEQ ID NO:49), HSMUC1A_PEA_1_T30 (SEQ ID NO:50), HSMUC1A_PEA_1_T31 (SEQ ID NO:51), HSMUC1A_PEA_1_T30 (SEQ ID NO:52), HSMUC1A_PEA1_T34 (SEQ ID NO:53), HSMUC1A_PEA_1_T35 (SEQ ID NO:54), HSMUC1A_PEA_1_T36 (SEQ ID NO:55), HSMUC1A_PEA_1_T40 (SEQ ID NO:56), HSMUC1A_PEA_1_T42 (SEQ ID NO:57), HSMUC1A_PEA_1_T43 (SEQ ID NO:58) and HSMUC1A_PEA_1_T47 (SEQ ID NO:59). Table 449 below describes the starting and ending position of this segment on each transcript.

TABLE 449

Segment location on transcripts

| Transcript name | Segment starting position | Segment ending position |
|---|---|---|
| HSMUC1A_PEA_1_T12 (SEQ ID NO:46) | 574 | 600 |
| HSMUC1A_PEA_1_T26 (SEQ ID NO:47) | 574 | 600 |
| HSMUC1A_PEA_1_T28 (SEQ ID NO:48) | 574 | 600 |
| HSMUC1A_PEA_1_T29 (SEQ ID NO:49) | 601 | 627 |
| HSMUC1A_PEA_1_T30 (SEQ ID NO:50) | 574 | 600 |
| HSMUC1A_PEA_1_T31 (SEQ ID NO:51) | 574 | 600 |
| HSMUC1A_PEA_1_T33 (SEQ ID NO:52) | 574 | 600 |
| HSMUC1A_PEA_1_T34 (SEQ ID NO:53) | 601 | 627 |
| HSMUC1A_PEA_1_T35 (SEQ ID NO:54) | 574 | 600 |
| HSMUC1A_PEA_1_T36 (SEQ ID NO:55) | 574 | 600 |
| HSMUC1A_PEA_1_T40 (SEQ ID NO:56) | 601 | 627 |
| HSMUC1A_PEA_1_T42 (SEQ ID NO:57) | 574 | 600 |
| HSMUC1A_PEA_1_T43 (SEQ ID NO:58) | 601 | 627 |
| HSMUC1A_PEA_1_T47 (SEQ ID NO:59) | 574 | 600 |

Segment cluster HSMUC1A_PEA_1_node_6 (SEQ ID NO:314) according to the present invention is supported by 35 libraries. The number of libraries was determined as previously described. This segment can be found in the following transcript(s): HSMUC1A_PEA_1_T12 (SEQ ID NO:46), HSMUC1A_PEA_1_T26 (SEQ ID NO:47), HSMUC1A_PEA_1_T28 (SEQ ID NO:48), HSMUC1A_PEA_1_T29 (SEQ ID NO:49), HSMUC1A_PEA_1_T30 (SEQ ID NO:50), HSMUC1A_PEA_1_T31 (SEQ ID NO:51), HSMUC1A_PEA_1_T33 (SEQ ID NO:52), HSMUC1A_PEA_1_T34 (SEQ ID NO:53), HSMUC1A_PEA_1_T35 (SEQ ID NO:54), HSMUC1A_PEA_1_T36 (SEQ ID NO:55), HSMUC1A_PEA_1_T40 (SEQ ID NO:56), HSMUC1A_PEA_1_T42 (SEQ ID NO:57), HSMUC1A_PEA_1_T43 (SEQ ID NO:58) and HSMUC1A_PEA_1_T47 (SEQ ID NO:59). Table 450 below describes the starting and ending position of this segment on each transcript.

TABLE 450

Segment location on transcripts

| Transcript name | Segment starting position | Segment ending position |
|---|---|---|
| HSMUC1A_PEA_1_T12 (SEQ ID NO:46) | 601 | 638 |
| HSMUC1A_PEA_1_T26 (SEQ ID NO:47) | 601 | 638 |
| HSMUC1A_PEA_1_T28 (SEQ ID NO:48) | 601 | 638 |
| HSMUC1A_PEA_1_T29 (SEQ ID NO:49) | 628 | 665 |
| HSMUC1A_PEA_1_T30 (SEQ ID NO:50) | 601 | 638 |
| HSMUC1A_PEA_1_T31 (SEQ ID NO:51) | 601 | 638 |
| HSMUC1A_PEA_1_T33 (SEQ ID NO:52) | 601 | 638 |
| HSMUC1A_PEA_1_T34 (SEQ ID NO:53) | 628 | 665 |
| HSMUC1A_PEA_1_T35 (SEQ ID NO:54) | 601 | 638 |
| HSMUC1A_PEA_1_T36 (SEQ ID NO:55) | 601 | 638 |
| HSMUC1A_PEA_1_T40 (SEQ ID NO:56) | 628 | 665 |
| HSMUC1A_PEA_1_T42 (SEQ ID NO:57) | 601 | 638 |
| HSMUC1A_PEA_1_T43 (SEQ ID NO:58) | 628 | 665 |
| HSMUC1A_PEA_1_T47 (SEQ ID NO:59) | 601 | 638 |

Segment cluster HSMUC1A_PEA_1_node_7 (SEQ ID NO:315) according to the present invention is supported by 32 libraries. The number of libraries was determined as previously described. This segment can be found in the following transcript(s): HSMUC1A_PEA_1_T12 (SEQ ID NO:46), HSMUC1A_PEA_1_T26 (SEQ ID NO:47), HSMUC1A_PEA_1_T28 (SEQ ID NO:48), HSMUC1A_PEA_1_T29 (SEQ ID NO:49), HSMUC1A_PEA_1_T30 (SEQ ID NO:50), HSMUC1A_PEA_1_T31 (SEQ ID NO:51), HSMUC1A_PEA_1_T33 (SEQ ID NO:52), HSMUC1A_PEA_1_T34(SEQ ID NO:53), HSMUC1A_PEA_1_T35 (SEQ ID NO:54), HSMUC1A_PEA_1_T36 (SEQ ID NO:55), HSMUC1A_PEA_1_T40 (SEQ ID NO:56), HSMUC1A_PEA_1_T42 (SEQ ID NO:57) and HSMUC1A_PEA_1_T43 (SEQ ID NO:58). Table 451 below describes the starting and ending position of this segment on each transcript.

TABLE 451

Segment location on transcripts

| Transcript name | Segment starting position | Segment ending position |
|---|---|---|
| HSMUC1A_PEA_1_T12 (SEQ ID NO:46) | 639 | 665 |
| HSMUC1A_PEA_1_T26 (SEQ ID NO:47) | 639 | 665 |
| HSMUC1A_PEA_1_T28 (SEQ ID NO:48) | 639 | 665 |
| HSMUC1A_PEA_1_T29 (SEQ ID NO:49) | 666 | 692 |
| HSMUC1A_PEA_1_T30 (SEQ ID NO:50) | 639 | 665 |
| HSMUC1A_PEA_1_T31 (SEQ ID NO:51) | 639 | 665 |
| HSMUC1A_PEA_1_T33 (SEQ ID NO:52) | 639 | 665 |
| HSMUC1A_PEA_1_T34 (SEQ ID NO:53) | 666 | 692 |
| HSMUC1A_PEA_1_T35 (SEQ ID NO:54) | 639 | 665 |
| HSMUC1A_PEA_1_T36 (SEQ ID NO:55) | 639 | 665 |
| HSMUC1A_PEA_1_T40 (SEQ ID NO:56) | 666 | 692 |
| HSMUC1A_PEA_1_T42 (SEQ ID NO:57) | 639 | 665 |
| HSMUC1A_PEA_1_T43 (SEQ ID NO:58) | 666 | 692 |

Segment cluster HSMUC1A_PEA_1_node_17 (SEQ ID NO:316) according to the present invention can be found in the following transcript(s): HSMUC1A_PEA_1_T28 (SEQ ID NO:48), HSMUC1A_PEA_1_T33 (SEQ ID NO:52) and HSMUC1A_PEA_1_T40 (SEQ ID NO:56). Table 452 below describes the starting and ending position of this segment on each transcript.

TABLE 452

Segment location on transcripts

| Transcript name | Segment starting position | Segment ending position |
|---|---|---|
| HSMUC1A_PEA_1_T28 (SEQ ID NO:48) | 666 | 684 |
| HSMUC1A_PEA_1_T33 (SEQ ID NO:52) | 666 | 684 |
| HSMUC1A_PEA_1_T40 (SEQ ID NO:56) | 693 | 711 |

Segment cluster HSMUC1A_PEA_1_node_18 (SEQ ID NO:317) according to the present invention is supported by 90 libraries. The number of libraries was determined as previously described. This segment can be found in the following transcript(s): HSMUC1A_PEA_1_T12 (SEQ ID NO:46), HSMUC1A_PEA_1_T26 (SEQ ID NO:47), HSMUC1A_PEA_1_T28 (SEQ ID NO:48), HSMUC1A_PEA_1_T29 (SEQ ID NO:49), HSMUC1A_PEA_1_T30 (SEQ ID NO:50), HSMUC1A_PEA_1_T33 (SEQ ID NO:52), HSMUC1A_PEA_1_T35 (SEQ ID NO:54), HSMUC1A_PEA_1_T40 (SEQ ID NO:56), and HSMUC1A_PEA_1_T42 (SEQ ID NO:57). Table 453 below describes the starting and ending position of this segment on each transcript.

TABLE 453

Segment location on transcripts

| Transcript name | Segment starting position | Segment ending position |
|---|---|---|
| HSMUC1A_PEA_1_T12 (SEQ ID NO:46) | 842 | 891 |
| HSMUC1A_PEA_1_T26 (SEQ ID NO:47) | 666 | 715 |
| HSMUC1A_PEA_1_T28 (SEQ ID NO:48) | 685 | 734 |
| HSMUC1A_PEA_1_T29 (SEQ ID NO:49) | 693 | 742 |
| HSMUC1A_PEA_1_T30 (SEQ ID NO:50) | 666 | 715 |
| HSMUC1A_PEA_1_T33 (SEQ ID NO:52) | 685 | 734 |
| HSMUC1A_PEA_1_T35 (SEQ ID NO:54) | 666 | 715 |
| HSMUC1A_PEA_1_T40 (SEQ ID NO:56) | 712 | 761 |
| HSMUC1A_PEA_1_T42 (SEQ ID NO:57) | 666 | 715 |

Segment cluster HSMUC1A_PEA_1_node_20 (SEQ ID NO:318) according to the present invention can be found in the following transcript(s): HSMUC1A_PEA_1_T12 (SEQ ID NO:46), HSMUC1A_PEA_1_T26 (SEQ ID NO:47), HSMUC1A_PEA_1_T28 (SEQ ID NO:48), HSMUC1A_PEA_1_T33 (SEQ ID NO:52), HSMUC1A_PEA_1_T35 (SEQ ID NO:54) and HSMUC1A_PEA_1_T42 (SEQ ID NO:57). Table 454 below describes the starting and ending position of this segment on each transcript.

TABLE 454

Segment location on transcripts

| Transcript name | Segment starting position | Segment ending position |
|---|---|---|
| HSMUC1A_PEA_1_T12 (SEQ ID NO:46) | 892 | 900 |
| HSMUC1A_PEA_1_T26 (SEQ ID NO:47) | 716 | 724 |
| HSMUC1A_PEA_1_T28 (SEQ ID NO:48) | 735 | 743 |
| HSMUC1A_PEA_1_T33 (SEQ ID NO:52) | 735 | 743 |
| HSMUC1A_PEA_1_T35 (SEQ ID NO:54) | 716 | 724 |
| HSMUC1A_PEA_1_T42 (SEQ ID NO:57) | 716 | 724 |

Segment cluster HSMUC1A_PEA_1_node_21 (SEQ ID NO:319) according to the present invention is supported by 97 libraries. The number of libraries was determined as previously described. This segment can be found in the following transcript(s): HSMUC1A_PEA_1_T12 (SEQ ID NO:46), HSMUC1A_PEA_1_T26 (SEQ ID NO:47), HSMUC1A_PEA_1_T28 (SEQ ID NO:48), HSMUC1A_PEA_1_T33 (SEQ ID NO:52), HSMUC1A_PEA_1_T35 (SEQ ID NO:54) and HSMUC1A_PEA_1_T42 (SEQ ID NO:57). Table 455 below describes the starting and ending position of this segment on each transcript.

TABLE 455

Segment location on transcripts

| Transcript name | Segment starting position | Segment ending position |
|---|---|---|
| HSMUC1A_PEA_1_T12 (SEQ ID NO:46) | 901 | 947 |
| HSMUC1A_PEA_1_T26 (SEQ ID NO:47) | 725 | 771 |
| HSMUC1A_PEA_1_T28 (SEQ ID NO:48) | 744 | 790 |
| HSMUC1A_PEA_1_T33 (SEQ ID NO:52) | 744 | 790 |
| HSMUC1A_PEA_1_T35 (SEQ ID NO:54) | 725 | 771 |
| HSMUC1A_PEA_1_T42 (SEQ ID NO:57) | 725 | 771 |

Segment cluster HSMUC1A_PEA_1_node_23 (SEQ ID NO:320) according to the present invention can be found in the following transcript(s): HSMUC1A_PEA_1_T12 (SEQ ID NO:46). Table 456 below describes the starting and ending position of this segment on each transcript.

TABLE 456

Segment location on transcripts

| Transcript name | Segment starting position | Segment ending position |
|---|---|---|
| HSMUC1A_PEA_1_T12 (SEQ ID NO:46) | 948 | 952 |

Segment cluster HSMUC1A_PEA_1_node_26 (SEQ ID NO:321) according to the present invention is supported by 129 libraries. The number of libraries was determined as previously described. This segment can be found in the following transcript(s): HSMUC1A_PEA_1_T12 (SEQ ID NO:46), HSMUC1A_PEA_1_T26 (SEQ ID NO:47), HSMUC1A_PEA_1_T28 (SEQ ID NO:48), HSMUC1A_PEA_1_T29 (SEQ ID NO:49), HSMUC1A_PEA_1_T30 (SEQ ID NO:50) and HSMUC1A_PEA_1_T31 (SEQ ID NO:51). Table 457 below describes the starting and ending position of this segment on each transcript.

TABLE 457

Segment location on transcripts

| Transcript name | Segment starting position | Segment ending position |
|---|---|---|
| HSMUC1A_PEA_1_T12 (SEQ ID NO:46) | 1085 | 1116 |
| HSMUC1A_PEA_1_T26 (SEQ ID NO:47) | 772 | 803 |
| HSMUC1A_PEA_1_T28 (SEQ ID NO:48) | 791 | 822 |
| HSMUC1A_PEA_1_T29 (SEQ ID NO:49) | 743 | 774 |
| HSMUC1A_PEA_1_T30 (SEQ ID NO:50) | 716 | 747 |
| HSMUC1A_PEA_1_T31 (SEQ ID NO:51) | 666 | 697 |

Segment cluster HSMUC1A_PEA_1_node_27 (SEQ ID NO:322) according to the present invention is supported by 140 libraries. The number of libraries was determined as previously described. This segment can be found in the following transcript(s): HSMUC1A_PEA_1_T12 (SEQ ID NO:46), HSMUC1A_PEA_1_T26 (SEQ ID NO:47), HSMUC1A_PEA_1_T28 (SEQ ID NO:48), HSMUC1A_PEA_1_T29 (SEQ ID NO:49), HSMUC1A_PEA_1_T30 (SEQ ID NO:50), HSMUC1A_PEA_1_T31 (SEQ ID NO:51), HSMUC1A_PEA_1_T33 (SEQ ID NO:52), HSMUC1A_PEA_1_T34 (SEQ ID NO:53), HSMUC1A_PEA_1_T35 (SEQ ID NO:54) and HSMUC1A_PEA_1_T36 (SEQ ID NO:55). Table 458 below describes the starting and ending position of this segment on each transcript.

TABLE 458

Segment location on transcripts

| Transcript name | Segment starting position | Segment ending position |
|---|---|---|
| HSMUC1A_PEA_1_T12 (SEQ ID NO:46) | 1117 | 1206 |
| HSMUC1A_PEA_1_T26 (SEQ ID NO:47) | 804 | 893 |
| HSMUC1A_PEA_1_T28 (SEQ ID NO:48) | 823 | 912 |
| HSMUC1A_PEA_1_T29 (SEQ ID NO:49) | 775 | 864 |
| HSMUC1A_PEA_1_T30 (SEQ ID NO:50) | 748 | 837 |
| HSMUC1A_PEA_1_T31 (SEQ ID NO:51) | 698 | 787 |
| HSMUC1A_PEA_1_T33 (SEQ ID NO:52) | 791 | 880 |
| HSMUC1A_PEA_1_T34 (SEQ ID NO:53) | 693 | 782 |
| HSMUC1A_PEA_1_T35 (SEQ ID NO:54) | 772 | 861 |
| HSMUC1A_PEA_1_T36 (SEQ ID NO:55) | 666 | 755 |

Segment cluster HSMUC1A_PEA_1_node_31 (SEQ ID NO:323) according to the present invention can be found in the following transcript(s): HSMUC1A_PEA_1_T12 (SEQ ID NO:46), HSMUC1A_PEA_1_T26 (SEQ ID NO:47), HSMUC1A_PEA_1_T28 (SEQ ID NO:48), HSMUC1A_PEA_1_T29 (SEQ ID NO:49), HSMUC1A_PEA_1_T30 (SEQ ID NO:50), HSMUC1A_PEA_1_T31 (SEQ ID NO:51); HSMUC1A_PEA_1_T33 (SEQ ID NO:52), HSMUC1A_PEA_1_T34 (SEQ ID NO:53), HSMUC1A_PEA_1_T35 (SEQ ID NO:54), HSMUC1A_PEA_1_T36 (SEQ ID NO:55), HSMUC1A_PEA_1_T40 (SEQ ID NO:56), HSMUC1A_PEA_1_T42 (SEQ ID NO:57) and HSMUC1A_PEA_1_T43 (SEQ ID NO:58) Table 459 below describes the starting and ending position of this segment on each transcript.

TABLE 459

Segment location on transcripts

| Transcript name | Segment starting position | Segment ending position |
|---|---|---|
| HSMUC1A_PEA_1_T12 (SEQ ID NO:46) | 1347 | 1356 |
| HSMUC1A_PEA_1_T26 (SEQ ID NO:47) | 1034 | 1043 |
| HSMUC1A_PEA_1_T28 (SEQ ID NO:48) | 1053 | 1062 |

TABLE 459-continued

Segment location on transcripts

| Transcript name | Segment starting position | Segment ending position |
|---|---|---|
| HSMUC1A_PEA_1_T29 (SEQ ID NO:49) | 1005 | 1014 |
| HSMUC1A_PEA_1_T30 (SEQ ID NO:50) | 978 | 987 |
| HSMUC1A_PEA_1_T31 (SEQ ID NO:51) | 928 | 937 |
| HSMUC1A_PEA_1_T33 (SEQ ID NO:52) | 1021 | 1030 |
| HSMUC1A_PEA_1_T34 (SEQ ID NO:53) | 923 | 932 |
| HSMUC1A_PEA_1_T35 (SEQ ID NO:54) | 1002 | 1011 |
| HSMUC1A_PEA_1_T36 (SEQ ID NO:55) | 896 | 905 |
| HSMUC1A_PEA_1_T40 (SEQ ID NO:56) | 902 | 911 |
| HSMUC1A_PEA_1_T42 (SEQ ID NO:57) | 912 | 921 |
| HSMUC1A_PEA_1_T43 (SEQ ID NO:58) | 833 | 842 |

Segment cluster HSMUC1A_PEA_1_node_34 (SEQ ID NO:324) according to the present invention is supported by 24 libraries. The number of libraries was determined as previously described. This segment can be found in the following transcript(s): HSMUC1A_PEA_1_T47 (SEQ ID NO:59). Table 460 below describes the starting and ending position of this segment on each transcript.

TABLE 460

Segment location on transcripts

| Transcript name | Segment starting position | Segment ending position |
|---|---|---|
| HSMUC1A_PEA_1_T47 (SEQ ID NO:59) | 639 | 665 |

Segment cluster HSMUC1A_PEA_1_node_36 (SEQ ID NO:325) according to the present invention is supported by 135 libraries. The number of libraries was determined as previously described. This segment can be found in the following transcript(s): HSMUC1A_PEA_1_T12 (SEQ ID NO:46), HSMUC1A_PEA_1_T26 (SEQ ID NO:47), HSMUC1A_PEA_1_T28 (SEQ ID NO:48), HSMUC1A_PEA_1_T29 (SEQ ID NO:49), HSMUC1A_PEA_1_T30 (SEQ ID NO:50), HSMUC1A_PEA_1_T31 (SEQ ID NO:51), HSMUC1A_PEA_1_T33 (SEQ ID NO:52), HSMUC1A_PEA_1_T34 (SEQ ID NO:53), HSMUC1A_PEA_1_T35 (SEQ ID NO:54), HSMUC1A_PEA_1_T36 (SEQ ID NO:55), HSMUC1A_PEA_1_T40 (SEQ ID NO:56), HSMUC1A_PEA_1_T42 (SEQ ID NO:57), HSMUC1A_PEA_1_T43 (SEQ ID NO:58) and HSMUC1A_PEA_1_T47 (SEQ ID NO:59). Table 461 below describes the starting and ending position of this segment on each transcript.

TABLE 461

Segment location on transcripts

| Transcript name | Segment starting position | Segment ending position |
|---|---|---|
| HSMUC1A_PEA_1_T12 (SEQ ID NO:46) | 1357 | 1388 |
| HSMUC1A_PEA_1_T26 (SEQ ID NO:47) | 1044 | 1075 |
| HSMUC1A_PEA_1_T28 (SEQ ID NO:48) | 1063 | 1094 |
| HSMUC1A_PEA_1_T29 (SEQ ID NO:49) | 1015 | 1046 |
| HSMUC1A_PEA_1_T30 (SEQ ID NO:50) | 988 | 1019 |
| HSMUC1A_PEA_1_T31 (SEQ ID NO:51) | 938 | 969 |
| HSMUC1A_PEA_1_T33 (SEQ ID NO:52) | 1031 | 1062 |
| HSMUC1A_PEA_1_T34 (SEQ ID NO:53) | 933 | 964 |
| HSMUC1A_PEA_1_T35 (SEQ ID NO:54) | 1012 | 1043 |
| HSMUC1A_PEA_1_T36 (SEQ ID NO:55) | 906 | 937 |
| HSMUC1A_PEA_1_T40 (SEQ ID NO:56) | 912 | 943 |
| HSMUC1A_PEA_1_T42 (SEQ ID NO:57) | 922 | 953 |
| HSMUC1A_PEA_1_T43 (SEQ ID NO:58) | 843 | 874 |
| HSMUC1A_PEA_1_T47 (SEQ ID NO:59) | 1190 | 1221 |

Segment cluster HSMUC1A_PEA_1_node_37 (SEQ ID NO:326) according to the present invention is supported by 146 libraries. The number of libraries was determined as previously described. This segment can be found in the following transcript(s): HSMUC1A_PEA_1_T12 (SEQ ID NO:46), HSMUC1A_PEA_1_T26 (SEQ ID NO:47), HSMUC1A_PEA_1_T28 (SEQ ID NO:48), HSMUC1A_PEA_1_T29 (SEQ ID NO:49), HSMUC1A_PEA_1_T30 (SEQ ID NO:50), HSMUC1A_PEA_1_T31 (SEQ ID NO:51), HSMUC1A_PEA_1_T33 (SEQ ID NO:52), HSMUC1A_PEA_1_T34 (SEQ ID NO:53), HSMUC1A_PEA_1_T35 (SEQ ID NO:54), HSMUC1A_PEA_1_T36 (SEQ ID NO:55), HSMUC1A_PEA_1_T40 (SEQ ID NO:56), HSMUC1A_PEA_1_T42 (SEQ ID NO:57), HSMUC1A_PEA_1_T43 (SEQ ID NO:58) and HSMUC1A_PEA_1_T47 (SEQ ID NO:59). Table 462 below describes the starting and ending position of this segment on each transcript.

TABLE 462

Segment location on transcripts

| Transcript name | Segment starting position | Segment ending position |
|---|---|---|
| HSMUC1A_PEA_1_T12 (SEQ ID NO:46) | 1389 | 1487 |
| HSMUC1A_PEA_1_T26 (SEQ ID NO:47) | 1076 | 1174 |
| HSMUC1A_PEA_1_T28 (SEQ ID NO:48) | 1095 | 1193 |
| HSMUC1A_PEA_1_T29 (SEQ ID NO:49) | 1047 | 1145 |
| HSMUC1A_PEA_1_T30 (SEQ ID NO:50) | 1020 | 1118 |
| HSMUC1A_PEA_1_T31 (SEQ ID NO:51) | 970 | 1068 |
| HSMUC1A_PEA_1_T33 (SEQ ID NO:52) | 1063 | 1161 |
| HSMUC1A_PEA_1_T34 (SEQ ID NO:53) | 965 | 1063 |
| HSMUC1A_PEA_1_T35 (SEQ ID NO:54) | 1044 | 1142 |
| HSMUC1A_PEA_1_T36 (SEQ ID NO:55) | 938 | 1036 |
| HSMUC1A_PEA_1_T40 (SEQ ID NO:56) | 944 | 1042 |
| HSMUC1A_PEA_1_T42 (SEQ ID NO:57) | 954 | 1052 |
| HSMUC1A_PEA_1_T43 (SEQ ID NO:58) | 875 | 973 |
| HSMUC1A_PEA_1_T47 (SEQ ID NO:59) | 1222 | 1320 |

Variant Protein Alignment to the Previously Known Protein:

Sequence name: MUC1_HUMAN
Sequence documentation:
Alignment of: HSMUC1A_PEA_1_P63 (SEQ ID NO:383) x MUC1_HUMAN
Alignment segment 1/1:
Quality: 429.00
Escore: 0
Matching length: 59
Total length: 59
Matching Percent Similarity: 86.44
Matching Percent Identity: 81.36
Total Percent Similarity: 86.44
Total Percent Identity: 81.36
Gaps: 0
Alignment:

```
  1   MTPGTQSPFFLLLLLTVLTVVTGSGHASSTPGGEKETSATQRSSVEEEVS   50
      ||||||||||||||||||||||||||||||||||||||||||||||
  1   MTPGTQSPFFLLLLLTVLTVVTGSGHASSTPGGEKETSATQRSSVPSSTE   50
```

```
51   ADQVSVGAS                                            59
     : ||: :|
51   KNAVSMTSS                                            59
```

Expression of AA315457 Transcripts Which are Detectable by SEQ ID NO:413 in Normal, Benign and Cancerous Prostate Tissues Expression of AA315457 transcripts detectable by SEQ ID NO:413 (e.g., variant no. 1 SEQ ID NO: 415) was measured by real time PCR. AA315457 is a non-limiting example of a marker according to the present invention. In parallel the expression of four housekeeping genes—PBGD (GenBank Accession No. BC019323 (SEQ ID NO:509); amplicon—SEQ ID NO:404), HPRT1 (GenBank Accession No. NM_000194 (SEQ ID NO:510): amplicon (SEQ ID NO:401)—SEQ ID NO: 402), RPL19 (GenBank Accession No. NM_000981 (SEQ ID NO:511); amplicon—SEQ ID NO:410) and SDHA (GenBank Accession No. NM_004168 (SEQ ID NO:508); amplicon—SEQ ID NO:407), was measured similarly. For each RT sample, the expression of SEQ ID NO:413 was normalized to the geometric mean of the quantities of the housekeeping genes. The normalized quantity of each RT sample was then divided by the median of the quantities of the normal post-mortem (PM) samples (Sample Nos. 42, 48-53, 59-63, Table 2, above), to obtain a value of fold up-regulation for each sample relative to median of the normal PM samples.

Figure 18A:
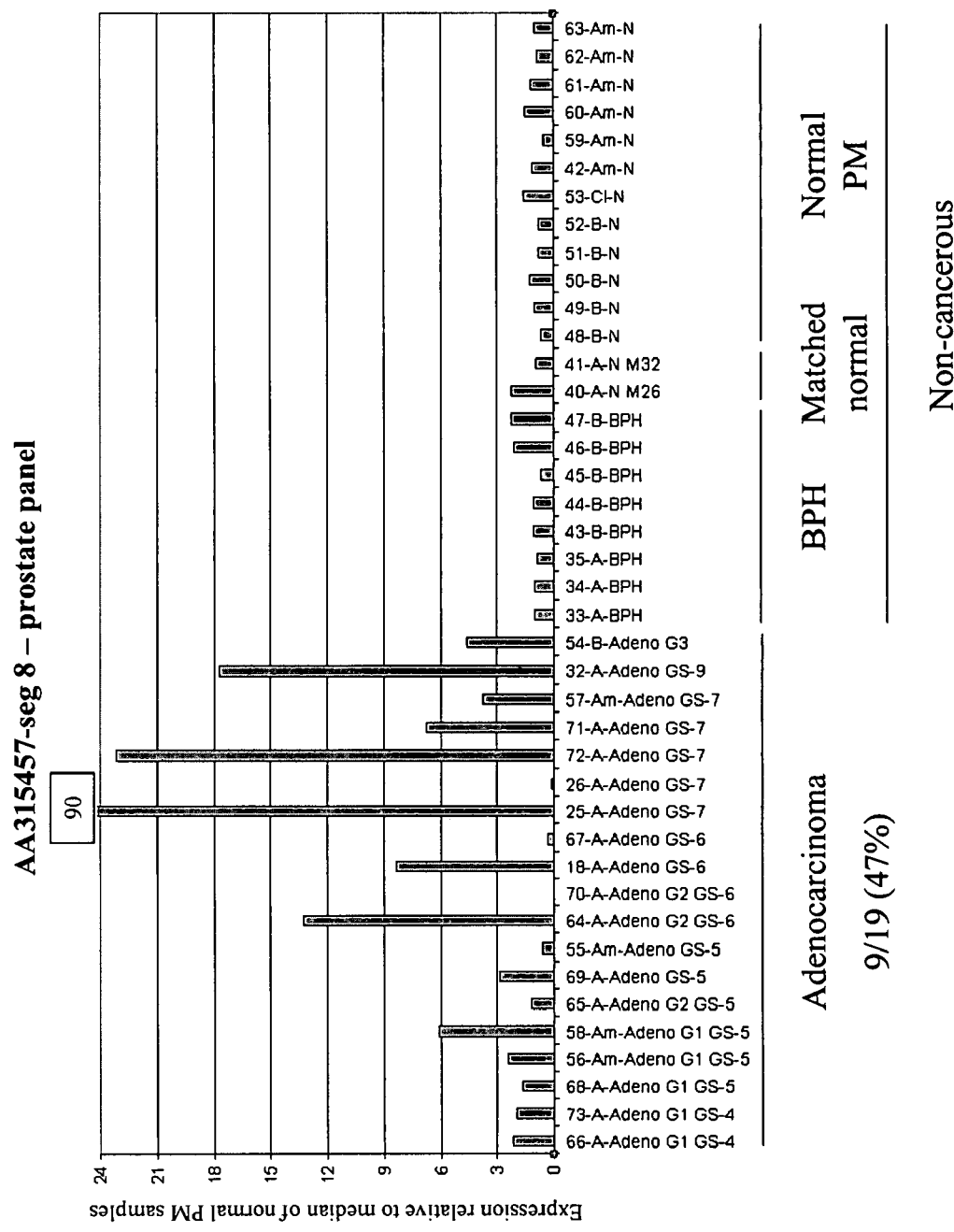
FIG. 18A-B is a histogram showing the relative expression of AA315457 variants in normal, benign and tumor derived prostate samples as determined by real time PCR using primers for SEQ ID NO: 413.
Figure 18B:
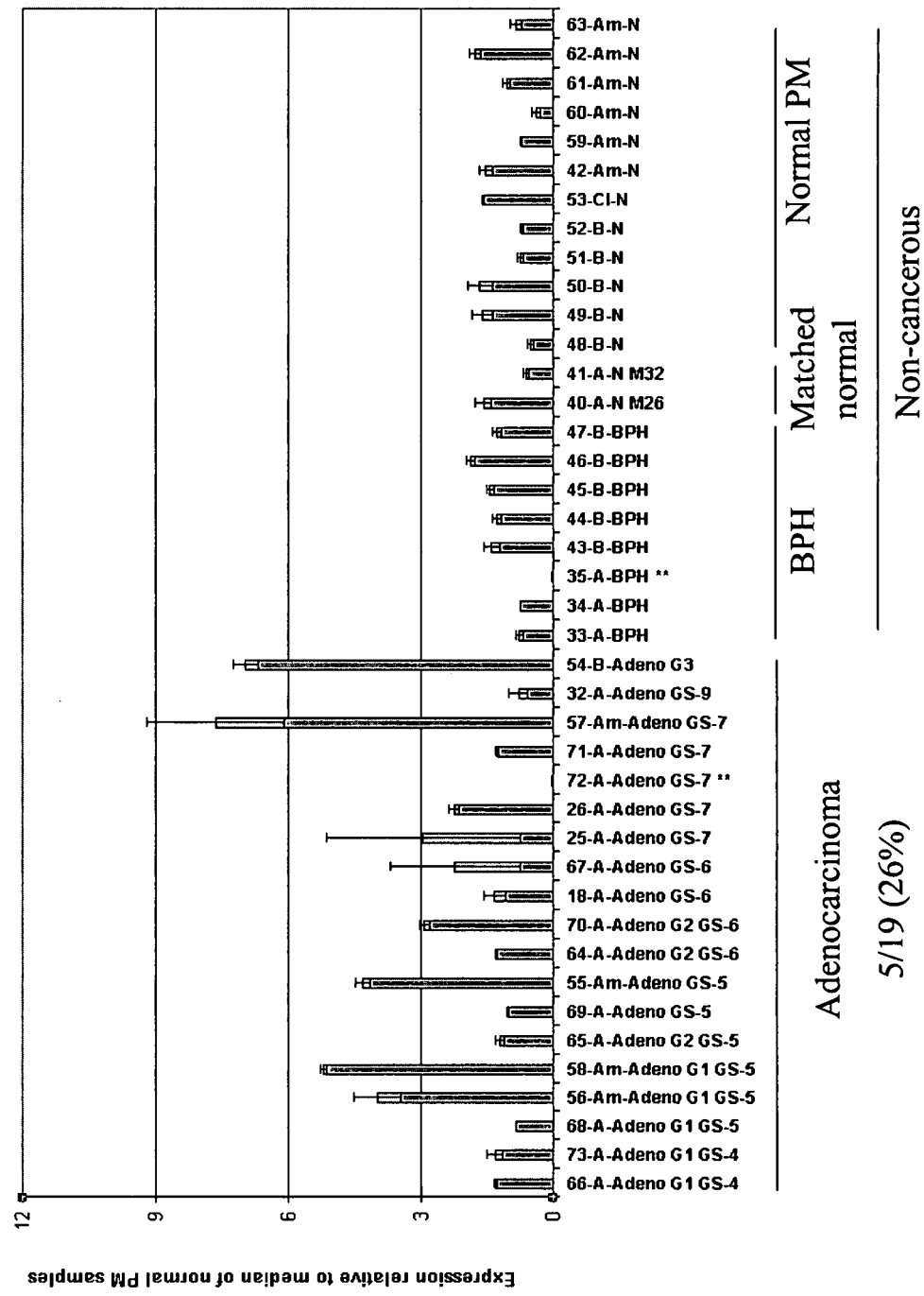

FIGS. 18A and 18B are histograms showing over expression of the above-indicated AA315457 transcripts in cancerous and benign (BPH) prostate samples relative to the normal samples. The number and percentage of cancer samples that exhibit at least 3 fold over-expression, out of the total number of samples tested is indicated in the bottom.

As is evident from FIGS. 18A and 18B, the expression of AA315457 transcripts detectable by SEQ ID NO:413 in cancer samples was significantly higher than in the non-cancerous samples (Sample Nos. 33-35, 43-47—BPH samples, 40-41—normal matched samples and 42, 48-53, 59-63—normal post mortem samples, Table 2). Notably an over-expression of at least 3 fold was found in 9 out of 19 adenocarcinoma samples. However, when an additional duplicate experiment was performed, the expression of SEQ ID NO:413 was weaker so just 5 out of 19 cancer samples showed overexpression of at least 3 fold, as shown with regard to FIG. 18B.

Statistical analysis was applied to verify the significance of these results, as described below.

The P value for the difference in the expression levels of AA315457 transcripts detectable by SEQ ID NO:413 in prostate cancer samples versus the normal prostate samples was determined by T test as 7.33E-02.

Threshold of 3 fold overexpression was found to differentiate between cancer and normal samples with P value of 4.58E-03 as checked by exact fisher test.

The P value for the difference between the expression levels of AA315457 transcripts detectable by SEQ ID NO:413 in the prostate cancer samples versus the BPH prostate samples was determined by T test as 8.04E-02.

Threshold of 3 fold overexpression was found to differentiate between cancer and BPH sample with P value of 1.97E-02 as checked by exact fisher test.

The P value for the difference between the expression levels of AA315457 transcripts detectable by SEQ ID NO:413 in the prostate cancer samples versus the BPH and normal prostate samples was determined by T test as 7.60E-02.

Threshold of 3 fold overexpression was found to differentiate between cancer sample and BPH and normal sample with P value of 4.36E-04 as checked by exact fisher test.

All the above values demonstrate statistical significance of the results.

According to the present invention, AA315457 is a non-limiting example of a marker for diagnosing prostate cancer. The AA315457 marker of the present invention can be used alone or in combination, for various uses, including but not limited to, prognosis, prediction, screening, early diagnosis, therapy selection and treatment monitoring of prostate cancer. Although optionally any method may be used to detect overexpression and/or differential expression of this marker, preferably a NAT-based technology is used. Therefore, optionally and preferably, any nucleic acid molecule capable of selectively hybridizing to AA315457 as previously defined is also encompassed within the present invention. Primer pairs are also optionally and preferably encompassed within the present invention; for example, for the above experiment, the following primer pair was used as a non-limiting illustrative example only of a suitable primer pair: AA315457—forward primer (SEQ ID NO: 411): CATG-GACCCCAGGCAAGTC; and AA315457—Reverse primer (SEQ ID NO: 412): CTGTTTAGGGTCGAGGCTGTG.

The present invention also preferably encompasses any amplicon obtained through the use of any suitable primer pair; for example, for the above experiment, the following amplicon was obtained as a non-limiting illustrative example only of a suitable amplicon_: AA315457 amplicon (SEQ ID NO: 413):

```
CATGGACCCCAGGCAAGTCCCCCCACCCACGCATTTCTAATCATCTGCCC
TGGTTTTGCCTCCTGAGTCTGTTAAGGCTGTGTGCCCCTCATCGAGGCCC
GTCACAGCCTCGACCCTAAACAG.
```

According to other preferred embodiments of the present invention, AA315457 or a fragment thereof comprises a biomarker for detecting prostate cancer. Optionally and more preferably, the fragment of AA315457 comprises AA315457_segment_8 (SEQ ID NO: 414). Also optionally and more preferably, any suitable method may be used for detecting a fragment such as AA315457_segment_8 for example. Most preferably, NAT-based technology used, such as any nucleic acid molecule capable of specifically hybridizing with the fragment. Optionally and most preferably, a primer pair is used for obtaining the fragment.

According to still other preferred embodiments, the present invention optionally and preferably encompasses any amino acid sequence or fragment thereof encoded by a nucleic acid sequence corresponding to AA315457 as described above, including but not limited to SEQ ID NOs: 414 and 415. Any oligopeptide or peptide relating to such an amino acid sequence or fragment thereof may optionally also (additionally or alternatively) be used as a biomarker.

The present invention also optionally encompasses antibodies capable of recognizing, and/or being elicited by, such an oligopeptide or peptide.

The present invention also optionally and preferably encompasses any nucleic acid sequence or fragment thereof, or amino acid sequence or fragment thereof, corresponding to AA315457 as described above, optionally for any application.

Expression of Thrombospondin 1 (THBS1) Transcripts Which are Detectable by SEQ ID NO:421 in Normal, Benign and Cancerous Prostate Tissues Expression of Thrombospondin 1 (THBS1) transcripts detectable by SEQ ID NO:421, segment 24 (e.g., variants no. 10,11 and 30; SEQ ID NOs: 441, 442, and 451) was measured by real time PCR, according to the exemplary marker HUMTHROM-segment 24 (SEQ ID NO:425). In parallel the expression of four housekeeping genes—PBGD (GenBank Accession No. BC019323 (SEQ ID NO:509); amplicon—SEQ ID NO:404), HPRT1 (GenBank Accession No. NM_000194 (SEQ ID NO:510); amplicon_—SEQ ID NO:401), RPL19 (GenBank Accession No. NM_000981 (SEQ ID NO:511); amplicon—SEQ ID NO:410) and SDHA (GenBank Accession No. NM_004168 (SEQ ID NO:508); amplicon_—SEQ ID NO:407), was measured similarly. For each RT sample, the expression of SEQ ID NO:421 was normalized to the geometric mean of the quantities of the housekeeping genes. The normalized quantity of each RT sample was then divided by the median of the quantities of the normal post-mortem (PM) samples (Sample Nos. 42, 48-53, 59-63, Table 2, above), to obtain a value of fold up-regulation for each sample relative to median of the normal PM samples.

Figure 19:
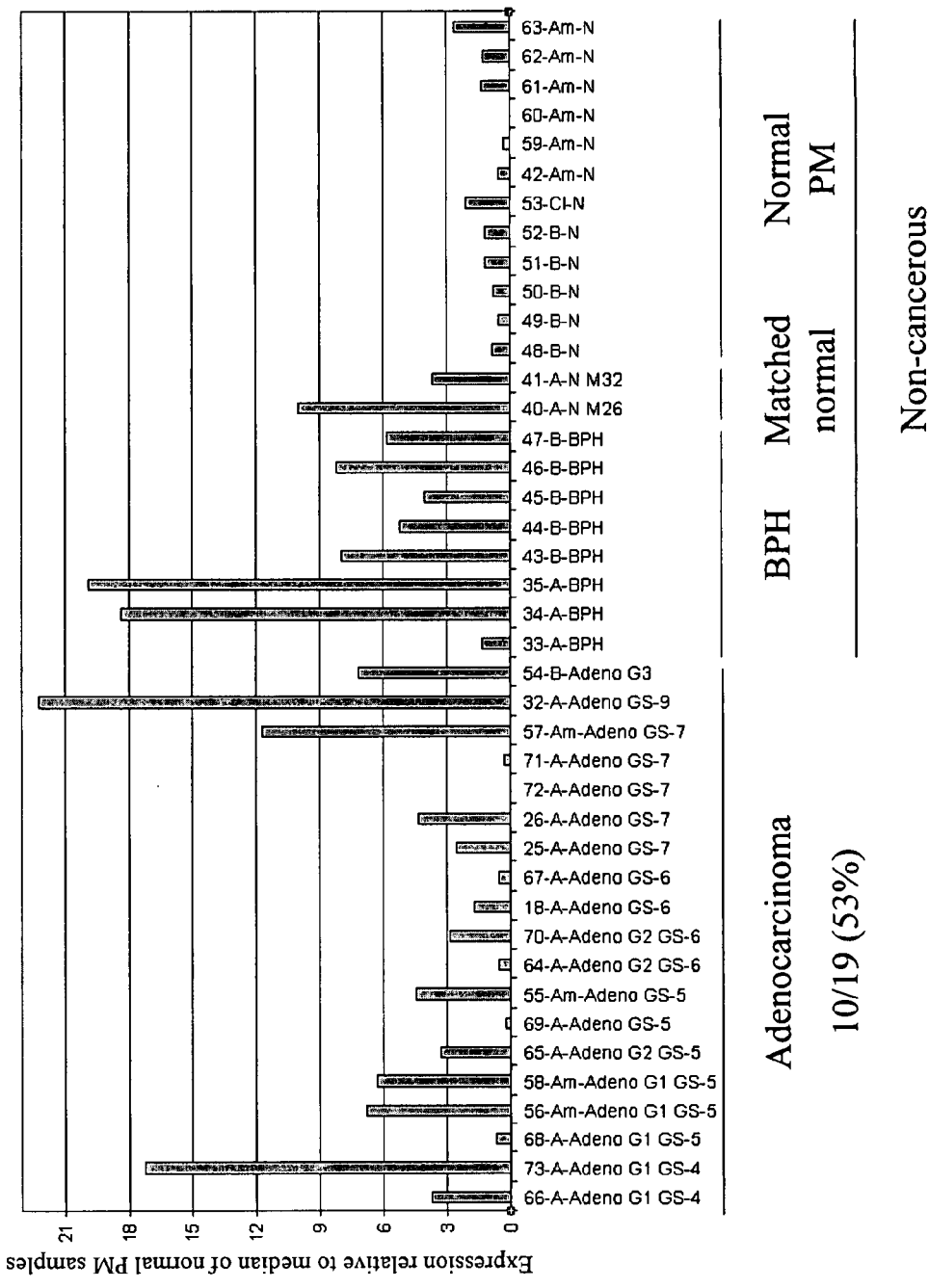
FIG. 19 is a histogram showing the relative expression of Thrombospondin 1 (THBS1) variants in normal, benign and tumor derived prostate samples as determined by real time PCR using primers for SEQ ID NO: 421.

FIG. 19 is a histogram showing over expression of the above-indicated Thrombospondin 1 (THBS1) transcripts in cancerous and benign (BPH) prostate samples relative to the normal samples. The number and percentage of cancer samples that exhibit at least 3 fold over-expression, out of the total number of samples tested is indicated in the bottom.

As is evident from FIG. 19, the expression of Thrombospondin 1 (THBS1) transcripts detectable by SEQ ID NO:421 in cancer samples was significantly higher than in the normal PM samples (Sample Nos. 42, 48-53, 59-63, Table 2). Notably an over-expression of at least 3 fold was found in 10 out of 19 adenocarcinoma samples. Over expression of at least 3 fold was observed also in 7 out of the 8 BPH samples, and in the 2 matched normal samples. Since matched samples are histologically non-cancerous tissue that surrounds the tumor, such samples could have been contaminated with cancer or pre-cancer cells.

Statistical analysis was applied to verify the significance of these results, as described below.

The P value for the difference in the expression levels of Thrombospondin 1 (THBS1) transcripts detectable by SEQ ID NO:421 in prostate cancer samples versus the normal prostate samples was determined by T test as 9.92E-03.

Threshold of 3 fold overexpression was found to differentiate between cancer and normal samples with P value of 2.08E-03 as checked by exact fisher test.

The above value demonstrates statistical significance of the results.

According to the present invention, HUMTHROM is a non-limiting example of a marker for diagnosing prostate cancer. The HUMTHROM marker of the present invention, can be used alone or in combination, for prognosis, prediction, screening, early diagnosis, therapy selection and treatment monitoring of prostate cancer. Although optionally any method may be used to detect overexpression and/or differential expression of this marker, preferably a NAT-based technology is used. Therefore, optionally and preferably, any nucleic acid molecule capable of selectively hybridizing to HUMTHROM as previously defined is also encompassed within the present invention. Primer pairs are also optionally and preferably encompassed within the present invention; for example, for the above experiment, the following primer pair was used as a non-limiting illustrative example only of a suitable primer pair: HUMTHROM-seg24—forward (SEQ ID NO:419): CTGCAGGCTCAGCAACTTCTT; and HUMTHROM-seg24—reverse (SEQ ID NO:420): TTTCAAATCCCTCCCTTGTCA.

The present invention also preferably encompasses any amplicon obtained through the use of any suitable primer pair; for example, for the above experiment, the following amplicon was obtained as a non-limiting illustrative example only of a suitable amplicon_: Amplicon from seg 24: (SEQ ID NO:421)

CTGCAGGCTCAGCAACTTCTTTTAATGAAAAACAAACTCACCCTCTTCCC

CAGCATTCTTTCCATGTGTCAGAGAAGCAGAGGTTTCTTGAACGGGCTTA

GGAGAGTCTATGACAAGGGAGGGATTTGAAA.

According to other preferred embodiments of the present invention, HUMTHROM or a fragment thereof comprises a biomarker for detecting prostate cancer. Optionally and more preferably, the fragment of HUMTHROM comprises HUMTHROM-seg24 (SEQ ID NO:425). Also optionally and more preferably, any suitable method may be used for detecting a fragment such as HUMTHROM-seg24 for example. Most preferably, NAT-based technology used, such as any nucleic acid molecule capable of specifically hybridizing with the fragment. Optionally and most preferably, a primer pair is used for obtaining the fragment.

Optionally the HUMTHROM transcript could (additionally or alternatively) comprise any one or more of the following sequences: SEQ ID NOs: 435-440; 443-445; 447-450.

According to still other preferred embodiments, the present invention optionally and preferably encompasses any amino acid sequence or fragment thereof encoded by a nucleic acid sequence corresponding to HUMTHROM as described above or below. Any oligopeptide or peptide relating to such an amino acid sequence or fragment thereof may optionally also (additionally or alternatively) be used as a biomarker. The present invention also optionally encompasses antibodies capable of recognizing, and/or being elicited by, such an oligopeptide or peptide.

Also, optionally and preferably HUMTHROM could be detected by detection of an amino acid sequence according to any of SEQ ID NOs 452-463, for which the unique regions relating to the splice variants are given separately and additionally in SEQ ID NOs 464-472. The present invention also encompasses these amino acid sequences as a biomarker for detecting prostate cancer.

The present invention also optionally and preferably encompasses any nucleic acid sequence or fragment thereof, or amino acid sequence or fragment thereof, corresponding to HUMTHROM as described above or below, optionally for any application.

Expression of Thrombospondin 1 (THBS1) Transcripts Which are Detectable by SEQ ID NO:418 in Normal, Benign and Cancerous Prostate Tissues Expression of Thrombospondin 1 (THBS1) transcripts detectable by SEQ ID NO:418, segment 19 (e.g., variant no. 18; SEQ ID NO: 446) was measured by real time PCR, according to the exemplary, illustrative marker HUMTHROM-segment 19 (SEQ ID NO: 423). In parallel the expression of four housekeeping genes—PBGD (GenBank Accession No. BC019323 (SEQ ID NO:509); amplicon_—SEQ ID NO:404), HPRT1 (GenBank Accession No. NM_000194 (SEQ ID NO:510); amplicon—SEQ ID NO:401), RPL19 (GenBank Accession No. NM_000981 (SEQ ID NO:511); amplicon—SEQ ID NO:410) and SDHA (GenBank Accession No. NM_004168 (SEQ ID NO:508); amplicon—SEQ ID NO:407), was measured similarly. For each RT sample, the expression of SEQ ID NO:418 was normalized to the geometric mean of the quantities of the housekeeping genes. The normalized quantity of each RT sample was then divided by the median of the quantities of the normal post-mortem (PM) samples (Sample Nos. 42, 48-53, 59-63, Table 2, above), to obtain a value of fold up-regulation for each sample relative to median of the normal PM samples.

Figure 20:
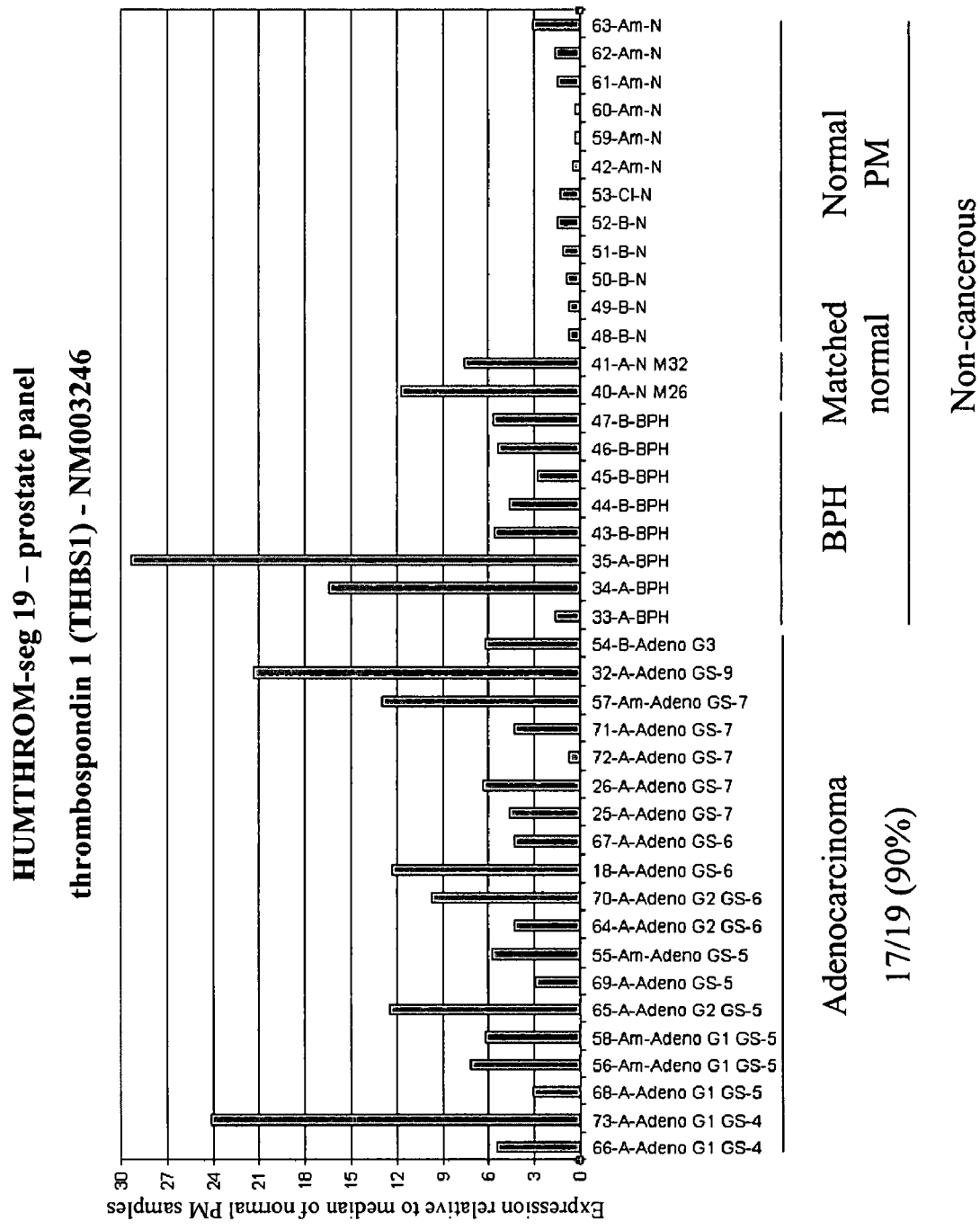
FIG. 20 is a histogram showing the relative expression of Thrombospondin 1 (THBS1) variants in normal, benign and tumor derived prostate samples as determined by real time PCR using primers for SEQ ID NO: 418.

FIG. 20 is a histogram showing over expression of the above-indicated Thrombospondin 1 (THBS1) transcripts in cancerous and benign (BPH) prostate samples relative to the normal samples. The number and percentage of cancer samples that exhibit at least 3 fold over-expression, out of the total number of samples tested is indicated in the bottom.

As is evident from FIG. 20, the expression of Thrombospondin 1 (THBS1) transcripts detectable by SEQ ID NO: 418 in cancer samples was significantly higher than in the normal PM samples (Sample Nos. 42, 48-53, 59-63, Table 2). Notably an over-expression of at least 3 fold was found in 17 out of 19 adenocarcinoma samples. Over expression of at least 3 fold was observed also in 6 out of the 8 BPH samples, and in the 2 matched normal samples. Since matched samples are histologically non-cancerous tissue that surrounds the tumor, such samples could have been contaminated with cancer or pre-cancer cells. These samples were purchased commercially with the matching non-cancerous tissue samples, as described above.

Statistical analysis was applied to verify the significance of these results, as described below.

The P value for the difference in the expression levels of Thrombospondin 1 (THBS1) transcripts detectable by SEQ ID NO: 418 in prostate cancer samples versus the normal prostate samples was determined by T test as 1.17E-04.

Threshold of 3 fold overexpression was found to differentiate between cancer and normal samples with P value of 1.00E-05 as checked by exact fisher test.

The P value for the difference between the expression levels of Thrombospondin 1 (THBS1) transcripts detectable by SEQ ID NO: 418 in the prostate cancer samples versus the BPH and normal prostate samples was determined by T test as 7.36E-$O_2$. Threshold of 3 fold overexpression was found to differentiate between cancer sample and BPH and normal sample with P value of 5.42E-04 as checked by exact fisher test.

All the above values demonstrate statistical significance of the results.

According to the present invention, HUMTHROM is a non-limiting example of a marker for diagnosing prostate cancer. Although optionally any method may be used to detect overexpression and/or differential expression of this marker, preferably a NAT-based technology is used. Therefore, optionally and preferably, any nucleic acid molecule capable of selectively hybridizing to HUMTHROM as previously defined is also encompassed within the present invention. Primer pairs are also optionally and preferably encompassed within the present invention; for example, for the above experiment, the following primer pair was used as a non-limiting illustrative example only of a suitable primer pair:HUMTHROM-seg19—forward (SEQ ID NO:416): AAAGCATCCGATTACCCCACT and HUMTHROM-seg 19—reverse (SEQ ID NO:417): CCGGCACAAAGTTGCAGTTA.

The present invention also preferably encompasses any amplicon obtained through the use of any suitable primer pair; for example, for the above experiment, the following amplicon was obtained as a non-limiting illustrative example only of a suitable amplicon_: Amplicon from seg 19:

AAAGGGCGAGGAGATGAATGTACGGTCTAGTTTTAGAAACGTGATTAGAA

AATCCATGGTAAATCCTGCAGGGGAAAAACAGTCTTCCATATTTAAAAAT

GCTGCTCTGGAATAAGTTGTGAGCAGATGGACTTGTAAACGCCTAGGTGC

TGAGCA.

According to other preferred embodiments of the present invention, HUMTHROM or a fragment thereof comprises a biomarker for detecting prostate cancer. Optionally and more preferably, the fragment of HUMTHROM comprises HUMTHROM-seg19 (SEQ ID NO: 423). Also optionally and more preferably, any suitable method may be used for detecting a fragment such as HUMTHROM-seg19 for example. Most preferably, NAT-based technology used, such as any nucleic acid molecule capable of specifically hybridizing with the fragment. Optionally and most preferably, a primer pair is used for obtaining the fragment.

Comparison of Expression of 3 Sequences (SEQ ID NO: 413, 418 and 421) in Normal, Benign and Cancerous Prostate Tissues Expression of transcripts detectable by SEQ ID NO: 413, 418 and 421 was measured by real time PCR (the expression of each SEQ ID was checked separately). These transcripts correspond to markers described with Examples above. In parallel the expression of four housekeeping genes—PBGD (GenBank Accession No. BC019323 (SEQ ID NO:509); amplicon—SEQ ID NO:404), HPRT1 (GenBank Accession No. NM_000194 (SEQ ID NO:510); amplicon—SEQ ID NO:401), RPL19 (GenBank Accession No. NM_000981 (SEQ ID NO:511); amplicon_—SEQ ID NO:410) and SDHA (GenBank Accession No. NM_004168 (SEQ ID NO:508); amplicon—SEQ ID NO:407), was measured similarly. For each RT sample, the expression was normalized to the geometric mean of the quantities of the housekeeping genes. The normalized quantity of each RT sample was then divided by the median of the quantities of the normal post-mortem (PM) samples (Sample Nos. 42, 48-53, 59-63, Table 2, above), to obtain a value of fold up-regulation for each sample relative to median of the normal PM samples.

Figure 21X:
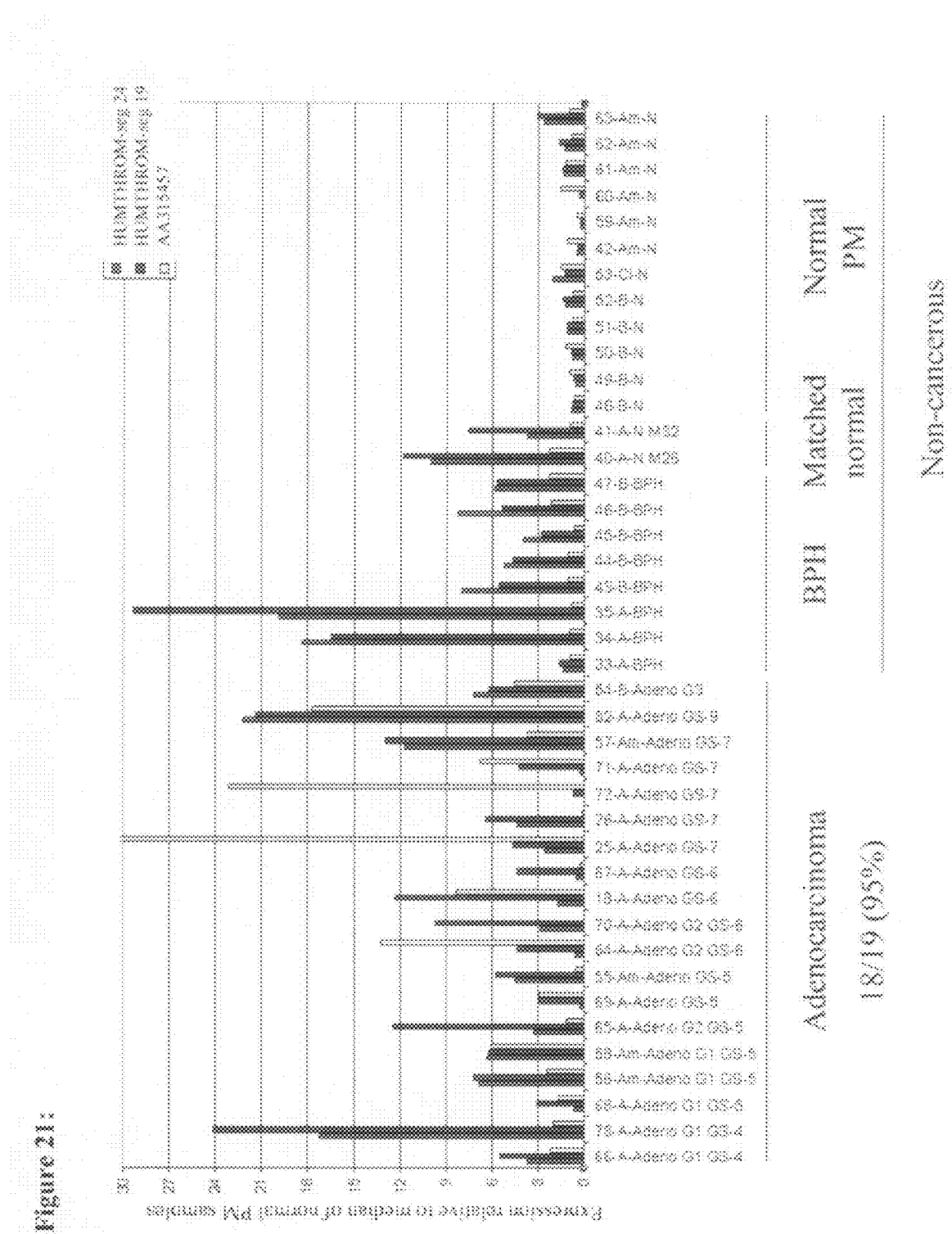
FIG. 21 is a histogram showing the relative expression of transcripts detectable by SEQ ID NOs: 413, 418 and 421 in normal, benign and tumor derived prostate samples as determined by real time PCR.

FIG. 21 is a histogram showing over expression of the above-indicated transcripts in cancerous and benign (BPH) prostate samples relative to the normal samples. The number and percentage of cancer samples that exhibit at least 3 fold over-expression of at least one marker according to the present invention, out of the total number of samples tested, is indicated in the bottom.

As is evident from FIG. 21, over-expression of at least 3 fold of at least one of the SEQ ID NO: 413, 418 and 421 was found in 18 out of 19 adenocarcinoma samples taken from prostate tissue (almost all prostate cancers are adenocarcinomas). Overexpression of at least 3 fold of at least one marker according to the present invention was observed in 7 out of the 8 BPH samples, and in the 2 matched normal samples. Since matched samples are histologically non-cancerous tissue that surrounds the tumor, such samples could have been contaminated with cancer or pre-cancer cells. However, at least certain markers were shown to be capable of differentiating between BPH and prostate cancer, such as AA315457 for example.

Statistical analysis was applied to verify the significance of these results, as described below. Threshold of 3 fold overexpression of at least one of the amplicons as depicted in SEQ ID NO: 413, 418 and 421 was found to differentiate between cancer and normal samples with P value of 1.62E-06 as checked by exact fisher test.

Expression of DD3/PCA3 Transcript Which are Detectable by SEQ ID NO:475 in Normal, Benign and Cancerous Prostate Tissues Expression of DD3/PCA3 transcripts detectable by the amplicon of SEQ ID NO:475 (e.g., variant no. 0; SEQ ID NO: 476; SEQ ID NO:483 is the forward primer, SEQ ID NO:474 is the reverse primer), related to cluster AA578773, segments 1 and 6, was measured by real time PCR. In parallel the expression of four housekeeping genes—PBGD (GenBank Accession No. BC019323 (SEQ ID NO:509); amplicon—SEQ ID NO:404), HPRT1 (GenBank Accession No. NM_000194 (SEQ ID NO:510); amplicon—SEQ ID NO:401), RPL19 (GenBank Accession No. NM_000981 (SEQ ID NO:511); amplicon—SEQ ID NO:410) and SDHA (GenBank Accession No. NM_004168 (SEQ ID NO:508); amplicon—SEQ ID NO:407), was measured similarly. For each RT sample, the expression was normalized to the geometric mean of the quantities of the housekeeping genes. The normalized quantity of each RT sample was then divided by the median of the quantities of the normal post-mortem (PM) samples (Sample Nos. 42, 48-53, 59-63, Table 2, above), to obtain a value of fold up-regulation for each sample relative to median of the normal PM samples.

Figure 22:
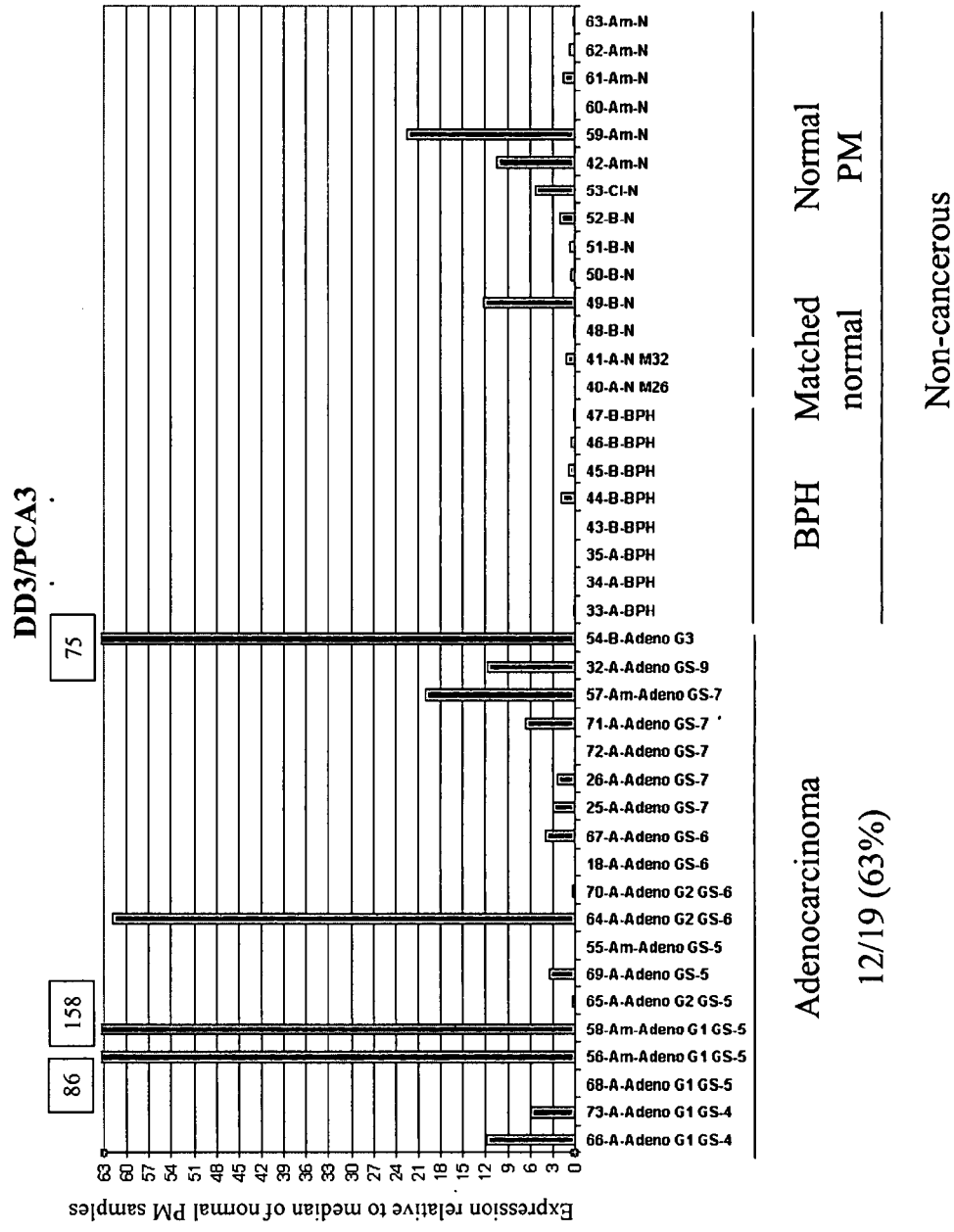
FIG. 22 is a histogram showing the relative expression of DD3/PCA3 variants in normal, benign and tumor derived prostate samples as determined by real time PCR using primers for SEQ ID NO:475.

FIG. 22 is a histogram showing over expression of the above-indicated DD3/PCA3 transcripts in cancerous and benign (BPH) prostate samples relative to the normal samples. The number and percentage of cancer samples that exhibit at least 3 fold over-expression, out of the total number of samples tested is indicated in the bottom.

As is evident from FIG. 22, an over-expression of at least 3 fold was found in 12 out of 19 adenocarcinoma (prostate cancer) samples. Over expression of at least 3 fold was observed also in 4 out of the 12 normal PM samples.

Thus, clearly DD3 may optionally be used as a biomarker in combination with any previously described biomarker according to the present invention. The DD3 marker of the present invention, can be used alone or in combination, for prognosis, prediction, screening, early diagnosis, therapy selection and treatment monitoring of prostate cancer.

Expression of Thrombospondin 1 (THBS1) Transcripts Which are Detectable by SEQ IDs NOs:477-482 in Normal, Benign and Cancerous Prostate Tissues Expression of Thrombospondin 1 (THBS1) transcripts detectable by SEQ ID NOs: 477-482 (e.g., variants nos. 4, 6, 8, 11, 14, 15, 26, 27, 28, 30 (SEQ ID No.: 435, 437, 439, 442, 444, 445, 448, 449, 450, 451) was measured with oligonucleotide-based micro-arrays. The results of image intensities for each feature were normalized according to the ninetieth percentile of the image intensities of all the features on the chip. Then, feature image intensities for repli-cates of the same oligonucleotide on the chip and replicates of the same sample were averaged. Outlying results were discarded.

Figure 23:
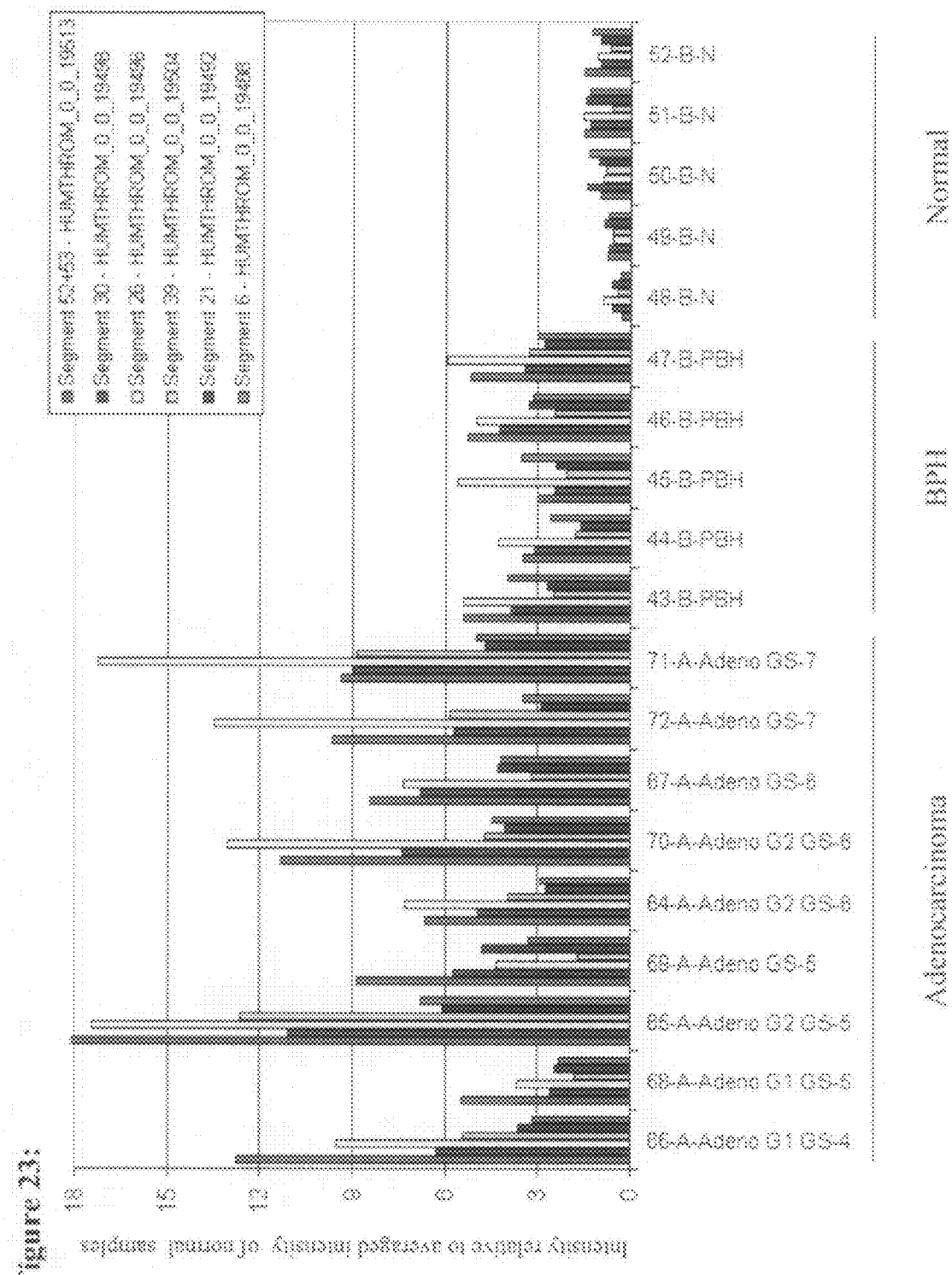
FIG. 23 is a histogram showing the relative expression of Thrombospondin 1 (THBS1) variants (e.g., variants no. 4, 6, 8, 11, 14, 15, 26, 27, 28, 30) in normal, benign and tumor derived prostate samples as determined by oligonucleotide-based micro-array experiments with SEQ ID NOs: 477, 478, 479, 480, 481, 482. For every oligonucleotide (SEQ ID NOs: 477, 478, 479, 480, 481, 482) the averaged intensity determined for every sample was divided by the averaged intensity of all the normal samples.

For every oligonucleotide (SEQ ID NOs: 477-482) the averaged intensity determined for every sample was divided by the averaged intensity of all the normal samples (Sample Nos. 48-52, Table 2, above), to obtain a value of fold up-regulation for each sample relative to the averaged normal samples. These data are presented in a histogram in FIG. 23. As is evident from FIG. 23, the expression of Thrombospondin 1 (THBS1) transcripts detectable with oligonucleotides according to SEQ ID NOs: 477-482 in cancer samples was significantly higher than in the normal samples.

According to the present invention, Thrombospondin 1 (THBS1) transcripts detectable by oligonucleotides as depicted in SEQ ID NOs: 477-482 are non-limiting examples of markers for diagnosing lung cancer. The Thrombospondin 1 (THBS1) markers of the present invention can be used alone or in combination, for a number of uses, including but not limited to, prognosis, prediction, screening, early diagnosis, therapy selection and treatment monitoring of prostate cancer. Although optionally any method may be used to detect overexpression and/or differential expression of this marker, preferably a NAT-based technology is used. Therefore, optionally and preferably, any nucleic acid molecule capable of selectively hybridizing to Thrombospondin 1 (THBS1) transcripts as previously defined is also encompassed within the present invention. Oligonucleotides are also optionally and preferably encompassed within the present invention; for example, for the above experiment, the following oligonucleotides were used as a non-limiting illustrative example only of a suitable oligonucleotides: SEQ ID NOs: 477-482

According to other preferred embodiments of the present invention, Thrombospondin 1 (THBS1) transcripts detectable by SEQ ID NOs: 477-482, or a fragment thereof comprises biomarkers for detecting prostate cancer. Optionally and more preferably, Thrombospondin I (THBS1) splice variants, as depicted in SEQ ID NO: 435, 437, 439, 442, 444, 445, 448, 449, 450, 451 (e.g., variant no. 4, 6, 8, 11, 14, 15, 26, 27, 28, 30), or a fragment thereof comprise a biomarker for detecting prostate cancer. Optionally and more preferably, any suitable method may be used for detecting a fragment such as Thrombospondin 1 (THBS1) transcripts as depicted in SEQ ID NOs: 435, 437, 439, 442, 444, 445, 448, 449, 450, 451 or fragments thereof. Most preferably, NAT-based technology used, such as any nucleic acid molecule capable of specifically hybridizing with the fragment. Optionally and most preferably, a primer pair is used for obtaining the fragment.

According to other preferred embodiments of the present invention, Thrombospondin 1 (THBS1) splice variants containing the unique segments as depicted in SEQ ID NOs: 422, 424-427, 431-433 (unique segments), for example as these included in variants 4, 6, 8, 11, 14, 15, 26, 27, 28, 30 (SEQ ID NOs: 435, 437, 439, 442, 444, 445, 448, 449, 450, 451, respectively), are useful as biomarkers for detecting prostate cancer.

Proteins containing unique amino acid sequences are 2, 3, 4, 5, 7, 10, 16, 17, and 18. The SEQ ID Nos for those proteins are: 452-456, 458, 461-463. The amino acid unique sequences are SEQ ID NO.s: 464-472 for variants P2, P3, P4, P5, P7, P10, P16, P17 and P18 (all from the cluster HUMTHROM as described in this example). The present invention also encompasses these amino acid sequences as a biomarker for detecting prostate cancer.

The present invention also optionally and preferably encompasses any nucleic acid sequence or fragment thereof, or amino acid sequence or fragment thereof, corresponding to Thrombospondin 1 (THBS1) variants as described above, optionally for any application.

A table is provided below with additional information concerning sequences according to the present invention.

| Variant | SEQ ID NO |
|---|---|
| HUMTHROM # TAA seg_6 (ver 3.4) #len 822 (node 6-ver 3.6) | 422 |
| HUMTHROM # TAA seg_21 (ver 3.4) #len 380 (node_16 ver 3.6) | 424 |
| HUMTHROM # TAA seg_26 (ver 3.4) #len 259 (node_20 ver 3.6) | 426 |
| HUMTHROM # TAA seg_30 (ver 3.4) #len 450 (node_24 ver 3.6) | 427 |
| HUMTHROM # TAA seg_33 (ver 3.4) #len 310 (node_53-ver 3.6) | 428 |
| HUMTHROM # TAA seg_35 (ver 3.4) #len 567 (node_28 ver 3.6) | 429 |
| HUMTHROM # TAA seg_37 (ver 3.4) #len 154 (node_30 ver 3.6) | 430 |
| HUMTHROM # TAA seg_39 (ver 3.4) #len 825 (node_32 ver 3.6) | 431 |
| HUMTHROM # TAA seg_50 (ver 3.4) #len 169 (node_38 ver 3.6) | 432 |
| HUMTHROM # TAA seg_52 + 53 (ver 3.4) #len 430 (node_40 ver 3.6) | 433 |
| HUMTHROM # TAA seg_55 (ver 3.4) #len 104 (node_42 ver 3.6) | 434 |
| HUMTHROM # transcript_5 #len 6508 (contains node 35-ver 3.4/node 28-ver 3.6) | 436 |
| HUMTHROM # transcript_7 #len 6095 (contains node 37-ver 3.4/node 30-ver 3.6) | 438 |
| HUMTHROM # transcript_9 #len 6662 (contains node 35-ver 3.4/node 28-ver 3.6; node 37-ver 3.4/node 30-ver 3.6) | 440 |
| HUMTHROM # transcript_12 #len 6110 (contains node 50-ver 3.4/node 38-ver 3.6) | 443 |
| HUMTHROM # transcript_20 #len 4335 (contains node 33-ver 3.4/node 53-ver 3.6; node 35-ver 3.4/node 28-ver 3.6) | 447 |
| >HUMTHROM_P8 # trn_12; trn_15 #len 1000 | 457 |
| >HUMTHROM_P12 # trn_18 #len 702 | 459 |
| >HUMTHROM_P13 # trn_20 #len 345 | 460 |

Kits and Diagnostic Assays and Methods

The markers described with regard to any of Examples 1-6 above can be used alone, in combination with other markers described above, and/or with other entirely different markers (including but not limited to DD3, PSA or prostate specific membrane antigen) to aid in the diagnosis of prostate cancer, benign prostate hyperplasia or a negative diagnosis. These markers can be used in combination with other markers for a number of uses, including but not limited to, prognosis, prediction, screening, early diagnosis, therapy selection and treatment monitoring of prostate cancer, and also optionally including staging of the disease. Used together, they tend to provide more information for the diagnostician, increasing the percentage of true positive and true negative diagnoses and decreasing the percentage of false positive or false negative diagnoses, than a single marker alone.

Assays and methods according to the present invention, as described above, include but are not limited to, immunoassays, hybridization assays and NAT-based assays. The combination of the markers of the present invention with other markers described above, and/or with other entirely different markers to aid in the diagnosis of prostate cancer could be carried out as a mix of NAT-based assays, immunoassays and hybridization assays. According to preferred embodiments of the present invention, the assays are NAT-based assays, as described for example with regard to the Examples above.

In yet another aspect, the present invention provides kits for aiding a diagnosis of prostate cancer, wherein the kits can be used to detect the markers of the present invention. For example, the kits can be used to detect any one or combination of markers described above, which markers are differentially present in samples of a prostate cancer patient, BPH and normal patients. The kits of the invention have many applications. For example, the kits can be used to differentiate if a subject has prostate cancer, BPH or has a negative diagnosis, thus aiding a prostate cancer diagnosis. In another example, the kits can be used to identify compounds that modulate expression of the markers in in vitro prostate cells or in vivo animal models for prostate cancer.

In one embodiment, a kit comprises: (a) a substrate comprising an adsorbent thereon, wherein the adsorbent is suitable for binding a marker, and (b) a washing solution or instructions for making a washing solution, wherein the combination of the adsorbent and the washing solution allows detection of the marker as previously described.

Optionally, the kit can further comprise instructions for suitable operational parameters in the form of a label or a separate insert. For example, the kit may have standard instructions informing a consumer/kit user how to wash the probe after a sample of seminal plasma or other tissue sample is contacted on the probe.

In another embodiment, a kit comprises (a) an antibody that specifically binds to a marker; and (b) a detection reagent. Such kits can be prepared from the materials described above.

In either embodiment, the kit may optionally further comprise a standard or control information, and/or a control amount of material, so that the test sample can be compared with the control information standard and/or control amount to determine if the test amount of a marker detected in a sample is a diagnostic amount consistent with a diagnosis of prostate cancer.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims. All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention.

SEQUENCE LISTING (575 sequences)

SEQ ID NO: 1 - DNA, 3544 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgcctttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 2 - DNA, 1584 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacggtaattctataactccttagagggtttccaaagaaaggtcttttgttgttcatgaactaagtgtcaccactgctcatgggcgaagtctttgaaaactctctccagactagagaatgttaactttaaacttaaaagcaagcatcttgagatggcagttgtcttttagtatcttttttccacccttggcctggggccaattggtgcaagattgtgaagttgcaaaaagcacctactgatttcatagtctcatggtacatttttatagcaaatattacctggtttcatttctttattgaacaaatattttctaagtttatattagg

SEQ ID NO: 3 - DNA, 1269 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagaggtcaggggtcaggaggatccagagggtgtggaggacaaatgtgtattagctcaatcccgtggacaaagcaaaatcctgctaggccagttgtcagttaatacagtgatggtctaagctttgcatctaagcttgtgccc

SEQ ID NO: 4 - DNA, 970 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactgtaagtatctcttagaagcttgttgacaccggggtaacatccacccaggattttttggtcaacccatgctggatccgcagatcagaggctctgaacacatgaggagcttaacttgacacctcttgacctgttgctaaggagaagtgatgggagaacgtg

SEQ ID NO: 5 - DNA, 1295 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccggttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttatacc

SEQ ID NO: 6 - DNA, 1367 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 7 - DNA, 1520 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 8 - DNA, 1371 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacagggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 9 - DNA, 2213 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttatacc

SEQ ID NO: 10 - DNA, 2247 bp, Homo sapiens
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgtctccgcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggtgagaatacccagaggccagcagccgaggccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgacactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctcccaggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttatacc

SEQ ID NO: 11 - DNA, 3866 bp, Homo sapiens
atcgcattacgtgaacaaatagctgaggggcggccgggccagaacggcttgtgtaactttgcaaacgtgccagaaagtttaaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtctcccagacctggtggccgacccctactacatccaggcgtccacgtacgtgcagaagatgtccatgtacaacctgagatgcgcggcggaggaaaactgtctggccagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtaaaacctggaaactatatcctaaaggtcagtgtaaaccccagctacctggttcctgaatctgactataccaacaatgttgtgcgctgtgacattcgctacacaggacatcatgcgtatgcctcaggctgcacaatttcaccgtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctga

SEQ ID NO: 12 - DNA, 1507 bp, Homo sapiens
ggagcggcctaggggaggccaggggcccacctgggctggggctgtggagagggagtggctgggacgggaggaaaaagagagacggagattagatggaagaagagggatttcaagacaaattgccagagatgcagtcagagagactgactgagagacacaaagatagaaggaattagagaaagggccacacagagccagacagagagagaagagtggagatggagacagggacgaggacagagaaaggcagacagacacatagggacagaaagagaaaaatcacacaaagtcagaattactgaatgacagggaatgacacatagaacgagacacagattcagagactcagggcagggaaaggaaggctgcagacagacagacagacagagggaggctgagacacagggagaagaggggcttggagaggtggcacaggcaggcagccagtgcctcagaggcctccggggagggccctcacacacaccccgccccggggcattaaggcagggcttggaggccagtcatcctgggcccgcccagggccgcccccctgccagcccgcctgcctggtgcctggcacctggcgctccaacccagcctacctgctgtagctgccgccactgccgtctccgccgccactgggcccccagagccccagccccagagcctaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagcctacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaatc

SEQ ID NO: 13 - DNA, 1266 bp, Homo sapiens
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtggaaagtgcatcttcctaagggcgagggtttcagcagtggttgaactcggcggggtggggcggagcgggaggatgcaaacttgcaaagtgaagcaaacacactcaccgcagcccagcaagggctctggcagctgacagggctttgtctgggacagctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagactttctgaggttgtgctttatttctgctgcgtcgtgggagagggcgggagggtgtcaggggagagtctgcccaggcctcaagggcaggaaaagactccctaaggagctgcagtgcatgcaaggatattttgaatccagactggcacccacgtcacaggaaagcctaggaacactgtaagtgccgcttcctcgggaaagcagaaaaaatacatttcaggtagaagttttcaaaaatcacaagtctttcttggtgaagacagcaagccaataaaactgtcttccaaagtggtcctttatttcacaaccactctcgctactgttcaatacttgtactattcctgggttttgtttctttgtacagtaaacattatgaacaaacaggcaaa

SEQ ID NO: 14 - DNA, 747 bp, Homo sapiens
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtcccagcaagggctctggcagctgacagggctttgtctgggacagctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccga

SEQ ID NO: 15 - DNA, 5989 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgaggccccataggagcctgagcatacaggagttgggggagccagggcccagtgaggggtggggaggctaaccgggccaggactctggccatcctcgttttcctgccctcaggtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 16 - DNA, 6134 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggtgatgtcaccctgtctgggcctcaggtgaccctgcttccatttccctgtaccccagctccctgttccctttgctcttagtgtaggaagagggtccagtgatctggggaggtctgtgccagcgtgcagctggcgtgggccagagggcagaggcggactgagacagagctgggtcacccccacccctccctcctgtggccctgaagctttgatggcccctctgatctctgcccctgtgcccacgcttcctttccctcaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 17 - DNA, 6247 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggtgatgtcaccctgtctgggcctcaggtgaccctgcttccatttccctgtaccccagctccctgttccctttgctcttagtgtaggaagagggtccagtgatctggggaggtctgtgccagcgtgcagctggcgtgggccagagggcagaggcggactgagacagagctgggtcacccccacccctccctcctgtggccctgaagctttgatggcccctctgatctctgcccctgtgcccacgcttcctttccctcaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgaggccccataggagcctgagcatacaggagttgggggagccagggcccagtgaggggtggggaggctaaccgggccaggactctggccatcctcgttttcctgccctcaggtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 18 - DNA, 6055 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggttctgggtgcaagggcaagcaggaggggggccaggaaaggacagttactggaagatggacagcccaggaggctacagagggaaagaaagggggcccctgatgaggatggggagcatggccttgggctcaaacagcagaagggtgagtgtcacctgagcggccacctctcctctccaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 19 - DNA, 5975 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggtttcttccagaggggaaggatgagtagggaggatgtggtagttaggagggctcagggtctgaccactctcttttgcctgccctcctttacctgcctaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 20 - DNA, 5673 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 21 - DNA, 7367 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 22 - DNA, 6925 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtgagggccagggaaggggtggggccaggcactggtggaggagagggtgtggagtgagaggcctgtgggcagaggcacatggtccggggaaggaggcagacacctcagggttggtgtcccgtgcttccgtcctgggtgtttttccccctgcttgctttcgcttgctctccccatctctgggtacctgttgtttcctttacccgcctcagtgctggtggctccgaatcccactcctcagcccaggcctcttccctgaaccatgggccccactcgtcccactcccacagcacctcagacgaggcatgtcccaaagcccttcttcattctgtgtctcttgtctggctggtgggagcccctcccagccaggagcccagccactactctagaggccgtgttagtggcccctctcccaagcctgtccttatgtccctagtgactcctcctctgctcccctgctgcctgtggcccttggtgctgcatcctagattctgtgctgagacggccttctccctacctggaacttctctctacctcctgtctcccctgtctgatccactgtccacacggcagtgacactgaccttccaaaagccccagccagatcagccttggggaaaagtcactccccgctgcccacggctcagatggctgggcctctgcccacccctccggccagacagctctccttgtctacacagatccccttgcctttcctgtccttccctgcttcttggcccacaggacaagctctttcttctccttcaagccttggccagaagcctttcctgagcttttcagtccagcctcttcccagcacagtctggagtgttggcctctgggggcaggcccctgcttctttacctctctgtatgcgccgccgcctgtggcgaatgtggtgccactcgtgtgtgtggactgtgcagtgacggggaggaaaaggggctgaaggcctcaaatcccgtagcccagggagatgcccttaggtatggcaccagagaggtctgtggcctcacatgtcccacgtcctctccctgccccttgctgagccaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 23 - DNA, 7571 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggtgggcgccgggagctgccctgggccaggggagggagggcaggacccaggctggggctgggcttctggagcccgcgcaggcagaacctggacgacagctcacacgtctccacaggcggaacggcaaggtggggctgtctggcatggccatcgcggacgtcaccctcctgagtggattccacgccctgcgtgctgacctggagaaggtgtggtcagccacccagggcaaccccctctgtcccaggtactgagccctgtcatgtgcagggcctgtgaccaactccccttttccacagctgacctccctctctgaccgttacgtgagtcactttgagaccgaggggccccacgtcctgctgtattttgactcggtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 24 - DNA, 6269 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcaggtgaaccactccctggtgaaccactccctcgcctgggtagccaggacacctgggcctcgtggccaggccagaagccgtccccaacctcccacccgtggaatccccgcagcacttcttcctggggtcttcgggggaagactgacttcctggctgcgtgacctggagctctgagcttcagttttctcacttgtagagtaacatacacagagttcaccctacagggtcgttagaaggctgaagtgagataattcatgtgctggtataaactttgtggaaatgtgaggtggggagaggaggtggggctgttttgaggaaggagataagttactggagccgcaaaaacaggtttgcttgtgcccttctaacatcgccttcccttttctgttgctgaagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 25 - DNA, 5829 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 26 - DNA, 6351 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagtaggggccgtccccgggctctggcgggggtgggtagtcctcagaccaagggcttgcttgagtcctggctcaacctccctaggacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcaggtgaaccactccctggtgaaccactccctcgcctgggtagccaggacacctgggcctcgtggccaggccagaagccgtccccaacctcccacccgtggaatccccgcagcacttcttcctggggtcttcgggggaagactgacttcctggctgcgtgacctggagctctgagcttcagttttctcacttgtagagtaacatacacagagttcaccctacagggtcgttagaaggctgaagtgagataattcatgtgctggtataaactttgtggaaatgtgaggtggggagaggaggtggggctgttttgaggaaggagataagttactggagccgcaaaaacaggtttgcttgtgcccttctaacatcgccttcccttttctgttgctgaagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 27 - DNA, 7532 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtccccacctcccgggagtgcgtgggctttgaggctgtgcaggaagtgccggtggggctggtgcagccggccagcgcaaccctgtacgactactacaaccccggtgagcactgcaggacaccctgaaattcaggagaactttggcataggtgccctcctatgggacaatggacaccggggtagtgagggggcagagagccctggggctccctgggactgaggaggcagaatggaggggcctgtgccctaactcctctctgttctccagagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 28 - DNA, 7765 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcagccaaggatgtcaaggccgctgctaatcagatgcgcaacttcctggttcgagcctcctgccgccttcgcttggaacctgggaaagaatatttgatcatgggtctggatggggccacctatgacctcgagggacagtgagtcatctggtcccctcagtctcttgtcctccccatgcctcgccacctaggccttgcccctcagaagccagatgcctgtgctctccgtttccacctgccatcctcccgagccctgctgactgcccctttgccccctgcagcccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggcagcgaagtgtcagtgtgtgttgctagggctgagagcagtgcccctgcccgatgcagttctgggcaggccaggttgacataaccttagactctctgagccctgatgacccttgggctgttcagctctgctagaacctcccagatgacccgctaggagtctagtgcttcacaggaccaccccgagcagaactgggacccaagagcctgcaccccaaggaccagagtccatgccaagaccacccttcagcttccaaggccctccactgcccggctgtcgccagtcaccacggcctcagacagggcttgtgctcagctgacacctgtgacacagctcttctgcctcatgagctgttgtccagctacacctccccgactctgtcctcgtgctgctggcggttctgaggtctgcagattttagctgagttccgggctgttgaaagcctgctgacgcttggttctgttatcagtggaatgaggtgactttcccggagttgtgcaatcctcaggtccggcagtgtcttcttccagttactggtttcaaacaagccaaaagtctgactttggtgtgtttgtgaatcctctgaggaagccgctgttctcctggggtctccccttcccaccggacctgcctaactttcccccatttagtggcacacctggggtcttcagagatgactccgcgtctgtccaaagaagtttggtgagatcagtttccgtagaggtcatgacagttcagcagcctgccatccagtcattcgacagaaattcgggaatctttcacttcatgccatgccctgtgccaggtgccagagatacagctgctcactccagggctcatcgctggggagacagataagaggacgggcagtccccaccctctgtgaaagatgtgatgtcagggagcagtgtggtcctgtggggcatctaaccaagtcaggggcattgccaggcagggacagggaaggcttcctggagcaggtggcctccaagtggggctctgaagactgagaaggagccaggcaaagagcaggggtagatgagggcatctggggcagaaggagaatatacaaaggcccagaggccgggggcaggacagggtacctttggggacattgcatgtaattgaccacattcggagtttggatttggaagtggtggaagagatggagatggtgagacaagtagtaagcacgtcagccttccaggtgcgctcctttccgatgagcactgtcttatcccacgtaactttgagaagtttgggcctttcccactgtggcagaggtttcctgaggctcttgcatacatggccctatggttgctcatcagatctttctcccagtagctgctcagcatggtggtggcataagcccattttccggagccagggattcagttgcagcaagacatggcccggtctgggaggtcaaccatgaagaaggcagtagctgtcattgcccaaccccagaaatcccaatcctgttttctc

SEQ ID NO: 29 - DNA, 7947 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggtcagtcttcccaccgaggccctggcctgaccctccctcggggaccggctgttttggtctctctgggtgtagcctgctcctcttacaggtcatgcacgcagcctgtttgctctgacaccaacttcctaccctctcagcctcaaagtaactcacctttcccccttctcctcaccccctcttaggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcagccaaggatgtcaaggccgctgctaatcagatgcgcaacttcctggttcgagcctcctgccgccttcgcttggaacctgggaaagaatatttgatcatgggtctggatggggccacctatgacctcgagggacagtgagtcatctggtcccctcagtctcttgtcctccccatgcctcgccacctaggccttgcccctcagaagccagatgcctgtgctctccgtttccacctgccatcctcccgagccctgctgactgcccctttgccccctgcagcccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggcagcgaagtgtcagtgtgtgttgctagggctgagagcagtgcccctgcccgatgcagttctgggcaggccaggttgacataaccttagactctctgagccctgatgacccttgggctgttcagctctgctagaacctcccagatgacccgctaggagtctagtgcttcacaggaccaccccgagcagaactgggacccaagagcctgcaccccaaggaccagagtccatgccaagaccacccttcagcttccaaggccctccactgcccggctgtcgccagtcaccacggcctcagacagggcttgtgctcagctgacacctgtgacacagctcttctgcctcatgagctgttgtccagctacacctccccgactctgtcctcgtgctgctggcggttctgaggtctgcagattttagctgagttccgggctgttgaaagcctgctgacgcttggttctgttatcagtggaatgaggtgactttcccggagttgtgcaatcctcaggtccggcagtgtcttcttccagttactggtttcaaacaagccaaaagtctgactttggtgtgtttgtgaatcctctgaggaagccgctgttctcctggggtctccccttcccaccggacctgcctaactttcccccatttagtggcacacctggggtcttcagagatgactccgcgtctgtccaaagaagtttggtgagatcagtttccgtagaggtcatgacagttcagcagcctgccatccagtcattcgacagaaattcgggaatctttcacttcatgccatgccctgtgccaggtgccagagatacagctgctcactccagggctcatcgctggggagacagataagaggacgggcagtccccaccctctgtgaaagatgtgatgtcagggagcagtgtggtcctgtggggcatctaaccaagtcaggggcattgccaggcagggacagggaaggcttcctggagcaggtggcctccaagtggggctctgaagactgagaaggagccaggcaaagagcaggggtagatgagggcatctggggcagaaggagaatatacaaaggcccagaggccgggggcaggacagggtacctttggggacattgcatgtaattgaccacattcggagtttggatttggaagtggtggaagagatggagatggtgagacaagtagtaagcacgtcagccttccaggtgcgctcctttccgatgagcactgtcttatcccacgtaactttgagaagtttgggcctttcccactgtggcagaggtttcctgaggctcttgcatacatggccctatggttgctcatcagatctttctcccagtagctgctcagcatggtggtggcataagcccattttccggagccagggattcagttgcagcaagacatggcccggtctgggaggtcaaccatgaagaaggcagtagctgtcattgcccaaccccagaaatcccaatcctgttttctc

SEQ ID NO: 30 - DNA, 5773 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 31 - DNA, 5961 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgagggtgagactgagggcctggggcggggcagtggaggcgggatggccggggccccccccacactgtctgatgggttccccaacttcagggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 32 - DNA, 7889 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgagggtgagactgagggcctggggcggggcagtggaggcgggatggccggggccccccccacactgtctgatgggttccccaacttcagggaagtgccctcgccagcgtcgcgccctggagcggggtctgcaggacgaggatggctacaggatgaagtttgcctgctactacccccgtgtggagtacggtcagtcttcccaccgaggccctggcctgaccctccctcggggaccggctgttttggtctctctgggtgtagcctgctcctcttacaggtcatgcacgcagcctgtttgctctgacaccaacttcctaccctctcagcctcaaagtaactcacctttcccccttctcctcaccccctcttaggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcagccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggcagcgaagtgtcagtgtgtgttgctagggctgagagcagtgcccctgcccgatgcagttctgggcaggccaggttgacataaccttagactctctgagccctgatgacccttgggctgttcagctctgctagaacctcccagatgacccgctaggagtctagtgcttcacaggaccaccccgagcagaactgggacccaagagcctgcaccccaaggaccagagtccatgccaagaccacccttcagcttccaaggccctccactgcccggctgtcgccagtcaccacggcctcagacagggcttgtgctcagctgacacctgtgacacagctcttctgcctcatgagctgttgtccagctacacctccccgactctgtcctcgtgctgctggcggttctgaggtctgcagattttagctgagttccgggctgttgaaagcctgctgacgcttggttctgttatcagtggaatgaggtgactttcccggagttgtgcaatcctcaggtccggcagtgtcttcttccagttactggtttcaaacaagccaaaagtctgactttggtgtgtttgtgaatcctctgaggaagccgctgttctcctggggtctccccttcccaccggacctgcctaactttcccccatttagtggcacacctggggtcttcagagatgactccgcgtctgtccaaagaagtttggtgagatcagtttccgtagaggtcatgacagttcagcagcctgccatccagtcattcgacagaaattcgggaatctttcacttcatgccatgccctgtgccaggtgccagagatacagctgctcactccagggctcatcgctggggagacagataagaggacgggcagtccccaccctctgtgaaagatgtgatgtcagggagcagtgtggtcctgtggggcatctaaccaagtcaggggcattgccaggcagggacagggaaggcttcctggagcaggtggcctccaagtggggctctgaagactgagaaggagccaggcaaagagcaggggtagatgagggcatctggggcagaaggagaatatacaaaggcccagaggccgggggcaggacagggtacctttggggacattgcatgtaattgaccacattcggagtttggatttggaagtggtggaagagatggagatggtgagacaagtagtaagcacgtcagccttccaggtgcgctcctttccgatgagcactgtcttatcccacgtaactttgagaagtttgggcctttcccactgtggcagaggtttcctgaggctcttgcatacatggccctatggttgctcatcagatctttctcccagtagctgctcagcatggtggtggcataagcccattttccggagccagggattcagttgcagcaagacatggcccggtctgggaggtcaaccatgaagaaggcagtagctgtcattgcccaaccccagaaatcccaatcctgttttctc

SEQ ID NO: 33 - DNA, 4914 bp, Homo sapiens
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcacgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 34 - DNA, 3194 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcaggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 35 - DNA, 2705 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagagctgggatttccatcctcaactggcagagatgagagcctggagcattgcagatgccagggacttcacaaatgaaggcacagcatgggaaacctgcgtgggttccagggcagtccagcctgcaggggcccagggagtggtcagtaggcatttgtcacagccaaatgccagtggaaggagcagccgcccaggcagccctctactgatgagagtaacctcacccgtgcactagtttacagagcattcactgccccagcttatcccaggcctcccgcttccctctgcgggtggggtgctgagcaggcattattggcctgcatgttttactgatgaggaaactgaggctgggagagtctgtggtaggggtcaagcaggtccacagtggcggggcatggcagtggtggctgggcaggtccttgcagccttccctctccggcaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 36 - DNA, 3332 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagagctgggatttccatcctcaactggcagagatgagagcctggagcattgcagatgccagggacttcacaaatgaaggcacagcatgggaaacctgcgtgggttccagggcagtccagcctgcaggggcccagggagtggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcaggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 37 - DNA, 3052 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagggactactggcgtttccaccccagcacccggcgtgtagacagtcccgtgccccgcagggccactgactggagaggggtgccctctgagatcgacgctgccttccaggatgctgatggtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcaggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 38 - DNA, 2359 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggaggtgaggccctgcctgccagtccccctactcctctgctggccactgtgactgcagcatatgccctcagcatgtgtccctctctcccaccccagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 39 - DNA, 2077 bp, Homo sapiens
caagcccagcagccccggggcggatggctccggccgcctggctccgcagcgcggccgcgcgcgccctcctgcccccgatgctgctgctgctgctccagccgccgccgctgctggcccgggctctgccgccggacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 40 - DNA, 6951 bp, Homo sapiens
cggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcggagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaattaggtcattccgaaactcatcattgaaccaggaagaagaagagttcaatcttactgccctagctctggagaatggcactgaattcgtttcttcgaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcagaagtcaagaacatgctaagcgtaagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaagggaaacagatattgaagactctgatgatattccagaagataccacatataagaaagggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctgtggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaaga

SEQ ID NO: 41 - DNA, 6996 bp, Homo sapiens
cggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcggagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaattaggtcattccgaaactcatcattgaaccaggaagaagaagagttcaatcttactgccctagctctggagaatggcactgaattcgtttcttcgaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcagaagtcaagaacatgctaagcgtaagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctgtggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaaga

SEQ ID NO: 42 - DNA, 2097 bp, Homo sapiens
cggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcggagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcagtaagtcagagtactatttttgttcatcagtttttcattcctgtggttgaaatatgactgtgcctagagtcagagacatggattaaaatctactcgctaaggggcacctccaatcctcacttccagtccaaagacttggtgatgaaatccgtg

SEQ ID NO: 43 - DNA, 4994 bp, Homo sapiens
gcaggcgcggcggcggcggcggaggcggaggcggccccgggctcgggcggctgggatggagcagaagagcgcggagcaccggagggcacgcagctgacggagctgcgctgcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcaccaaataccaggctaccatggtctacaagactctcttcgctctttgcatcttaactgcaggatggagggtacagagtctgcctacatcagctcctttgtctgtttctcttccgacaaacattgtaccaccgaccaccatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccaggttcgaattgggaaggcacaaacacagacccctcaccttctgggttctcgtcaacaagcggtggagtccacttaacaaccacgttggaggaacacagctcgggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccgacagaggagtccagctctgaccacacacccacttcacatgccacagctgagccagtaccccaggagaaaacacccccaacaactgtgtcaggcaaagtgatgtgtgagctcatagacatggagaccaccaccacctttcccagggtgatcatgcaggaagtagaacatgcattaagttcaggcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggaccgaggaggaggatttgggttgttttgttaggggttactttcaggggaacatttcatttgtgttatttcttaaacttctatttaggaaattacattaagtattaatgaggggaaaggaaatgagctctacgaggatttcaccctgcatgggagagagcagggttttctcagattcctttttaatctctatttatctggttgtttctgacaggatgctgcctgcttggctctacaagctggaaagcagcttcttagctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaaggaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcataggaaacagactatgattaatccatttattcttcccacacacttaccttactaagtctttgctttaataaatgagcaaccctgggtatagtcttaaaattctgcacaataaattttgagaaagaattgttcctctttgtaggtatctgtgtattgcaatcattctcaaccaggaggtgattttgccccctgactccaccccagggacattcaaaaatgtctggtgacagttttcattgtcatgacttgggggtgctactagaggccaggaatgctgccaaacattctaccatgcacagcacaacctacaacagcaaagaatcatccaccccaaaatatcagtagtgccgagattgagaaaccctgatttatcacaatgcccactgtgacagaacaagacactcacagattagtgatacgttttatttttaacaaaatgaaatgatgtgttaagtttttatttccaaagtgtttagtttattggctgatgggttgttcttggtatgcatggtgacctttttatttctgtgtgcttcctagagagctttatttcatggcgacaactctgtcttcttgtaacagctgatattagcaagcagcatcttatgtcctgatttcatatagtagaaaacaaacattgggtccgacttcaaaatgtgttgtattgtcctacagtgtcataaagaacctgaaaatgaacttttgtttctaaagttggaccttgctgccatgactgtttagtttacagaaacttgaccccggctcatcctgtctctggctgtggcccggcaaagcactgaaaacccctctggtctcagagacagtaggggcagtgccactttctacaacctgccaacccacacactggagtaattctgaaaaaaattattcctaaactctctaagtgtggacggagaatgagcaagccccagaagtattttacaaccagagtgggtaatgaggagggggcttactggaatcgtcatatctctgaatattgaaaacaacaactaaaaaagtggaccttctcagaaaaaaagggcagcaaatgaccaagggcgccccttctggccgtgcttggcttgagtaactgtctctctttccccacccccatcacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaaccgtgaactcaagcaggcattttttttttcttaccgaaaggctgctattgtgcaagggcacataatgggtctgttgctcttattggcttccaaatgtgcatggcaaagagagagatgtgggcctagagcagatatattcagcaaggtgacagcttcccataacaattctaacacttcttatcttatgtgagaataaaatatttaagggttgaaccttattttgccaaatgtatcttttctgcttttgaattgggcagaagattttagcaactatattctacaaatgttacttataacacacacacacacatctgaaatatatgccgaaaattgacgtctttgacctcagggagagcacctgtccaggtctgcctaaaggaaatggctccagtgggtctaaacaaccacatcctatccatggataggtctagtcataacactttagagagaatgtcagagcaggagggaggcaagccgcctcttctcggccatcaactgcagatgatgaaagagcgggattcaactttgttttcttttcctgtggccccagtgaaacctcctgccctccctgcacgtctgtgtcttcatttctaaaatgggggtgatgctttcatattgacctcaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaaacaggatggatacctgagcactaacagcagtagacgtagacctctgtcctttaccatctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaattataattatatcaattaaagttgataaaagcttc

SEQ ID NO: 44 - DNA, 3322 bp, Homo sapiens
gtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccaggtgcgcggctgccacgccacgccacaccatgctggtgcccggacccgccccctgggcccggcgtcccacccaccgggtggggccccacccttccctcccgggccgtgctggccaggtcatctgccgagggagggcagcccaggggcaccgtctccacagcccctgggatgggtctggggtgctctcctggtctttgtgtcggcgttcccctccctacctcctttcctctcgctcttgcagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactacctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgcgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctcca

SEQ ID NO: 45 - DNA, 2817 bp, Homo sapiens
gtccggacaggccgagatgacgccgagccccctgttgctgctcctgctgccgccgctgctgctgggggccttcccgccggccgccgccgcccgaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctggatgacattagcccagggaaggagagcctggggcccgacagctcctctgggggtcaagaggaccccgccagccagcagtgggcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccagcggacccgttccaagcccgtgctcacaggcacgcaccccgtgaacacgacggtggacttcggggggaccacgtccttccagtgcaagacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactacctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgcgtgcacagatatgctgtctggacacgcacacacatgcagatatgctgcctggacacacacttccagacacacgtgcacaggcgcagatatgctgcctggacacacgcagatatgctgtctagtcacacacacacgcagacatgctgtccggacacacacacgcatgcacagatatgctgtccggacacacacacgcacgcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctcca

SEQ ID NO: 46 - DNA, 1749 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctgctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacgatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 47 - DNA, 1436 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatgtttttgcagatttataaacaagggggttttctgggcctctccaatattaagttcagtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 48 - DNA, 1455 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcagtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 49 - DNA, 1407 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 50 - DNA, 1380 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 51 - DNA, 1330 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgcttgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 52 - DNA, 1423 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 53 - DNA, 1325 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgcttctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 54 - DNA, 1404 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatgtttttgcagatttataaacaagggggttttctgggcctctccaatattaagttcagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 55 - DNA, 1298 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgcttctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 56 - DNA, 1304 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 57 - DNA, 1314 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctatcccagcaccgactactaccaagagctgcagagagacatttctgaaatgtttttgcagatttataaacaagggggttttctgggcctctccaatattaagttcaggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 58 - DNA, 1235 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacaggttctggtcatgcaagctctaccccaggtggagaaaaggagacttcggctacccagagaagttcagtgcccagctctactgagaagaatgctgctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 59 - DNA, 1582 bp, Homo sapiens
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtagaagaagaagtgtcagcagaccaggtgagcgtgggtgccagtggggttcttgggagcttcaaggaagcaaggaacgctccctccttcctctcctggtctttctctatgggacctagtaaataattactgcagccacctgaggctggaaaaccactccaggtgggggaggagagagtttagttttcttgctcctattttcctcctcctggagacctccctctctcggctttacaaagacacagatacaccccgccccccaaaacacacacacacacacacacacacacacctccttaggctggaacagcagagaatggagggacaagggggctgattagagccaagaagagggagtgaaggagagcagagggaggagggcagccctgtttacagtcacctggctggtggggtggcaggtgctctctctgaattaaccctttgagagctggccaggactctggactgattaccccagcctggggtggcatccaggggctctaggaggtaccttttgctcctcaccctggatctcttttccttccacccaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 60 - DNA, 166 bp, Artificial
  Synthetic oligonucleotide
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctg

SEQ ID NO: 61 - DNA, 156 bp, Artificial
  Synthetic oligonucleotide
atcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacact

SEQ ID NO: 62 - DNA, 159 bp, Artificial
  Synthetic oligonucleotide
gtaagtatctcttagaagcttgttgacaccggggtaacatccacccaggattttttggtcaacccatgctggatccgcagatcagaggctctgaacacatgaggagcttaacttgacacctcttgacctgttgctaaggagaagtgatgggagaacgtg

SEQ ID NO: 63 - DNA, 176 bp, Artificial
  Synthetic oligonucleotide
gaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagag

SEQ ID NO: 64 - DNA, 137 bp, Artificial
  Synthetic oligonucleotide
gtcaggggtcaggaggatccagagggtgtggaggacaaatgtgtattagctcaatcccgtggacaaagcaaaatcctgctaggccagttgtcagttaatacagtgatggtctaagctttgcatctaagcttgtgccc

SEQ ID NO: 65 - DNA, 129 bp, Artificial
  Synthetic oligonucleotide
agtttccctacgtataccctggtggttcaagctgctgaccttcaaggtgaggggttaagcacaacagcaacagctgtgatcacagtcactgacaccaacgataatcctccgatcttcaatcccaccacg

SEQ ID NO: 66 - DNA, 323 bp, Artificial
  Synthetic oligonucleotide
gtaattctataactccttagagggtttccaaagaaaggtcttttgttgttcatgaactaagtgtcaccactgctcatgggcgaagtctttgaaaactctctccagactagagaatgttaactttaaacttaaaagcaagcatcttgagatggcagttgtcttttagtatcttttttccacccttggcctggggccaattggtgcaagattgtgaagttgcaaaaagcacctactgatttcatagtctcatggtacatttttatagcaaatattacctggtttcatttctttattgaacaaatattttctaagtttatattagg

SEQ ID NO: 67 - DNA, 144 bp, Artificial
  Synthetic oligonucleotide
gactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaa

SEQ ID NO: 68 - DNA, 157 bp, Artificial
  Synthetic oligonucleotide
aatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggg

SEQ ID NO: 69 - DNA, 484 bp, Artificial
  Synthetic oligonucleotide
gcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctg

SEQ ID NO: 70 - DNA, 120 bp, Artificial
  Synthetic oligonucleotide
ctcattactacactggtgtgtccctctgcctttttttttttttaagacagggtctcattctatcggccaggctggagtgcagtggtgcaatcacagctcactgcagccttgtcctcccag

SEQ ID NO: 71 - DNA, 190 bp, Artificial
  Synthetic oligonucleotide
ccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaag

SEQ ID NO: 72 - DNA, 593 bp, Artificial
  Synthetic oligonucleotide
ctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccag

SEQ ID NO: 73 - DNA, 149 bp, Artificial
  Synthetic oligonucleotide
gtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaac

SEQ ID NO: 74 - DNA, 299 bp, Artificial
  Synthetic oligonucleotide
ttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccatt

SEQ ID NO: 75 - DNA, 224 bp, Artificial
  Synthetic oligonucleotide
tgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcag

SEQ ID NO: 76 - DNA, 6 bp, Artificial
  Synthetic oligonucleotide
ctgcag

SEQ ID NO: 77 - DNA, 81 bp, Artificial
  Synthetic oligonucleotide
gcctccgtttctggaatccaagcagaattgctcacatttcccaactcctctcctggcctcagaagacagaagagagactgg

SEQ ID NO: 78 - DNA, 63 bp, Artificial
  Synthetic oligonucleotide
gttattcctcccatcagctgcccagaaaatgaaaaaggcccatttcctaaaaacctggttcag

SEQ ID NO: 79 - DNA, 16 bp, Artificial
  Synthetic oligonucleotide
ctcttctctcacgctg

SEQ ID NO: 80 - DNA, 117 bp, Artificial
  Synthetic oligonucleotide
tgtcatccaacgggaatgcagttgaggatccaatggagattttgatcacggtaaccgatcagaatgacaacaagcccgaattcacccaggaggtctttaaggggtctgtcatggaag

SEQ ID NO: 81 - DNA, 12 bp, Artificial
  Synthetic oligonucleotide
gtgctcttccag

SEQ ID NO: 82 - DNA, 115 bp, Artificial
  Synthetic oligonucleotide
gtctcctcttggctctgccaggagccggagccctgccaccctggctttgacgccgagagctacacgttcacggtgccccggcgccacctggagagaggccgcgtcctgggcagag

SEQ ID NO: 83 - DNA, 73 bp, Artificial
  Synthetic oligonucleotide
gcacagcctgtcgaagcaggattgcaaattcctgccattctggggattcttggaggaattcttgctttgctaa

SEQ ID NO: 84 - DNA, 34 bp, Artificial
  Synthetic oligonucleotide
ttctgattctgctgctcttgctgtttcttcggag

SEQ ID NO: 85 - DNA, 97 bp, Artificial
  Synthetic oligonucleotide
gagagcggtggtcaaagagcccttactgcccccagaggatgacacccgggacaacgtttattactatgatgaagaaggaggcggagaagaggaccag

SEQ ID NO: 86 - DNA, 113 bp, Artificial
  Synthetic oligonucleotide
gctcaagctatccttgcacctcagcctcccaagtagctgggaccacaggcatgcaccactacgcatgactaattttttaaatatttgagacggggtctccctgtgttacccag

SEQ ID NO: 87 - DNA, 74 bp, Artificial
  Synthetic oligonucleotide
gctggtctcaaactcctgggctcaagtgatcctcccatcttggcctcccagagtattgggattacagacatgag

SEQ ID NO: 88 - DNA, 51 bp, Artificial
  Synthetic oligonucleotide
ctggtcttaaactcctggcctcaagcaatccttctgccttggccccccaaa

SEQ ID NO: 89 - DNA, 22 bp, Artificial
  Synthetic oligonucleotide
gtgctgggattgtgggcatgag

SEQ ID NO: 90 - DNA, 153 bp, Artificial
  Synthetic oligonucleotide
acactaaaagaacaaacaccttgctcttcgagatgagacattttgccaagcagttgaccacttagttctcaagaagcaactatctctttcatgtgccttctgaggaagtattcagagggggaatatcaaatgtctttcccttggactctccca

SEQ ID NO: 91 - DNA, 744 bp, Artificial
  Synthetic oligonucleotide
ggtctcactgtgtcacgaggctggagtgcagtggaacaatttcagcacactgcaacctctgcctcccaggctcaaatgatcatcccacctaagcctccggagtagctgggaccacaggcaagcgccaccatgcccagctgataccaatgtcttttaaaaaatgttgtatgtggaaataaattgagacttatagaaaagctgcaaaaatagtgcagtttctatatatccttcccccatctttggctagtgttaacaatctacataaccgcagtacgatgatcaaggctaggaaattaacattggcacagtactgttaatgaaaccatgctttgttttgagattcccacagttttgcctttttctgttccaagatcctatccaggatcccacgttgcatttcattgtcatgtctccttctcctctaacctctgacaatgcatcattctttccatgtcttttgtgatgttgacacttttgaagaggactggtccagatttttgtacactgtccctcagtttgggattgtctgctgttttctcatgaacagatagaggttttgcatttttgacaagaatcctcagaagagatgcacccttctcagtgcactgtagcaaggggcgcatgctgtcaatgtcttactggtgatgttaactttgatcgcttttgattcagatagtatctgctgggtttttccactgtaaagttactattttttccattgtaattaataaataacttgaggga

SEQ ID NO: 92 - DNA, 174 bp, Artificial
  Synthetic oligonucleotide
gtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactg

SEQ ID NO: 93 - DNA, 309 bp, Artificial
  Synthetic oligonucleotide
agaagaggaagacaggaagggggtggggatgtgaagcgaccgtcccagccttccccgcccgccacccccaccccaactcggcagccgtcacgtgatgcctggagtgggaggtggggagaaaaggcgagacttttgtgggtgctcccgatcgccagtagttccttcagtctcagccgccaactccggaggcgcggtgctcggcccgggagcgcgagcgggaggagcagagacccgcagccgggagcccgagcgcgggcgatgcaggctccgcgagcggcacctgcggctcctctaagctacgaccgtcgt

SEQ ID NO: 94 - DNA, 487 bp, Artificial
  Synthetic oligonucleotide
gtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgc

SEQ ID NO: 95 - DNA, 418 bp, Artificial
  Synthetic oligonucleotide
ggagagacagagaaaagaaaaacacagcatgagaacacagtaaataaataaaaccataaaatatttagcccctctgttctgtgcttactggccaggaaatggtaccaatttttcagtgttggacttgacagcttcttttgccacaagcaagagagaatttaacactgtttcaaacccgggggagttggctgtgttaaagaaagaccattaaatgctttagacagtgtatttataccagttgatgtctgttaattttaaaaaaatgttttcattggtgtttgtttgcgtatccagaaagcagttcatgttatccataaatctggttttgtctttttttgttttaaagaaaaagatgtatacatacagtatagctgcattagataaagcagtgtttgtattttaaaggatgtctgcacaa

SEQ ID NO: 96 - DNA, 44 bp, Artificial
  Synthetic oligonucleotide
gctttgcgctgcaaatccagtgctaccagtgtgaagaattccag

SEQ ID NO: 97 - DNA, 94 bp, Artificial
  Synthetic oligonucleotide
ctgaacaacgactgctcctcccccgagttcattgtgaattgcacggtgaacgttcaagacatgtgtcagaaagaagtgatggagcaaagtgccg

SEQ ID NO: 98 - DNA, 4 bp, Artificial
  Synthetic oligonucleotide
acag

SEQ ID NO: 99 - DNA, 58 bp, Artificial
  Synthetic oligonucleotide
ggatcatgtaccgcaagtcctgtgcatcatcagcggcctgtctcatcgcctctgccgg

SEQ ID NO: 100 - DNA, 11 bp, Artificial
  Synthetic oligonucleotide
ctgaagctgaa

SEQ ID NO: 101 - DNA, 63 bp, Artificial
  Synthetic oligonucleotide
ggagatgccaccccctcctgcattgttcttccagccctcgcccccaaccccccacctccctga

SEQ ID NO: 102 - DNA, 30 bp, Artificial
  Synthetic oligonucleotide
tctgaaaagtgcttaagaaaatcttctcag

SEQ ID NO: 103 - DNA, 84 bp, Artificial
  Synthetic oligonucleotide
ttctccttgcagaggactggcgccgggacgcgaagagcaacgggcgctgcacaaagcgggcgctgtcggtggtggagtgcgcat

SEQ ID NO: 104 - DNA, 26 bp, Artificial
  Synthetic oligonucleotide
gtacgcgcaggcgcttctcgtggttg

SEQ ID NO: 105 - DNA, 113 bp, Artificial
  Synthetic oligonucleotide
gcgtgctgcagcgacaggcggcagcacagcacctgcacgaacacccgccgaaactgctgcgaggacaccgtgtacaggagcgggttgatgaccgagctgaggtagaaaaacgt

SEQ ID NO: 106 - DNA, 82 bp, Artificial
  Synthetic oligonucleotide
ctccgagaaggggaggaggatcatgtacgcccggaagtaggacctcgtccagtcgtgcttgggtttggccgcagccatgatc

SEQ ID NO: 107 - DNA, 24 bp, Artificial
  Synthetic oligonucleotide
ctccgaatctggttgggcatccag

SEQ ID NO: 108 - DNA, 28 bp, Artificial
  Synthetic oligonucleotide
catacggccaatgtcacaacaatcagcc

SEQ ID NO: 109 - DNA, 10 bp, Artificial
  Synthetic oligonucleotide
ctccgcggca

SEQ ID NO: 110 - DNA, 21 bp, Artificial
  Synthetic oligonucleotide
ctgggcagacacgagcaggag

SEQ ID NO: 111 - DNA, 52 bp, Artificial
  Synthetic oligonucleotide
gcagcgcgggccccagcagcctcggcagccacagccgctgcagccggggcag

SEQ ID NO: 112 - DNA, 43 bp, Artificial
  Synthetic oligonucleotide
cctccgctgctgtcgcctcctctgatgcgcttgccctctcccg

SEQ ID NO: 113 - DNA, 32 bp, Artificial
  Synthetic oligonucleotide
gccccgggactccgggagaatgtgggtcctag

SEQ ID NO: 114 - DNA, 39 bp, Artificial
  Synthetic oligonucleotide
gcatcgcggcaactttttgcggattgttcttgcttccag

SEQ ID NO: 115 - DNA, 34 bp, Artificial
  Synthetic oligonucleotide
gtgagaatacccagaggccagcagccgaggccag

SEQ ID NO: 116 - DNA, 609 bp, Artificial
  Synthetic oligonucleotide
atcgcattacgtgaacaaatagctgaggggcggccgggccagaacggcttgtgtaactttgcaaacgtgccagaaagtttaaaatctctcctccttccttcactccagacactgcccgctctccgggactgccgcgccgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtcc

SEQ ID NO: 117 - DNA, 133 bp, Artificial
  Synthetic oligonucleotide
catacagggcagatgtcagagattatgatcacagggtgctgctcagatttccccaaagagtgaaaaaccaagggacatcagatttcttacccagccgaccaagatattcctgggaatggcacagttgtcatca

SEQ ID NO: 118 - DNA, 157 bp, Artificial
  Synthetic oligonucleotide
acattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacag

SEQ ID NO: 119 - DNA, 1998 bp, Artificial
  Synthetic oligonucleotide
gtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccttagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatacttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaa

SEQ ID NO: 120 - DNA, 879 bp, Artificial
  Synthetic oligonucleotide
atggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctgaaatgtctgccttttaaatataacacctactatttggttaattttgacgatttttttttttcaattaggaagctaaaaatactactttattccttatatgaacattcatccccctcctggcacctctaaacacacccaaataactcacaagtactgatttaacactctgtattactgaacttctttgaactattttgaactttgaatctcttctctgaataactgccgaaactcaaagataataattagttgatgaaggttatcaattaataaaataacacagaccagtcttaccaaactctaaatacattttaaaaaataggaactggcaatgataaaaagaatgttgagtactgacaggagattggcttttacactaaaaaagacagaaaatggactaaataggaacataatttcagagtttatgagtcagtttacaatatgccatattagcgatctcatgatgattcagaccacagtctgggttaaagatgtcttgacctctgaggctagcataacatatatgagaatacaacttgcctatttccagaaaatctgtatatttttatagaataactttatttacaatttctatcatccaattactcactaggcattatttgtagtactttttttctcttt

SEQ ID NO: 121 - DNA, 272 bp, Artificial
  Synthetic oligonucleotide
cgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacg

SEQ ID NO: 122 - DNA, 59 bp, Artificial
  Synthetic oligonucleotide
ctggtgcagccaacgcctccgcccagcagccccgcactccgatcctgctgatccgcgac

SEQ ID NO: 123 - DNA, 96 bp, Artificial
  Synthetic oligonucleotide
ggattgagtcctggctgttatgatacctatggtgcagacatagactgccagtggattgatattacagatgtaaaacctggaaactatatcctaaag

SEQ ID NO: 124 - DNA, 24 bp, Artificial
  Synthetic oligonucleotide
gtcagtgtaaaccccagctacctg

SEQ ID NO: 125 - DNA, 92 bp, Artificial
  Synthetic oligonucleotide
gttcctgaatctgactataccaacaatgttgtgcgctgtgacattcgctacacaggacatcatgcgtatgcctcaggctgcacaatttcacc

SEQ ID NO: 126 - DNA, 8 bp, Artificial
  Synthetic oligonucleotide
aaccgcac

SEQ ID NO: 127 - DNA, 8 bp, Artificial
  Synthetic oligonucleotide
gtactcac

SEQ ID NO: 128 - DNA, 63 bp, Artificial
  Synthetic oligonucleotide
cgccgcggcgcgaacgcggacggccggctcatctggagtcaccgctggccgccccaggcccac

SEQ ID NO: 129 - DNA, 109 bp, Artificial
  Synthetic oligonucleotide
gtctcccagacctggtggccgacccctactacatccaggcgtccacgtacgtgcagaagatgtccatgtacaacctgagatgcgcggcggaggaaaactgtctggccag

SEQ ID NO: 130 - DNA, 157 bp, Artificial
  Synthetic oligonucleotide
ggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagcc

SEQ ID NO: 131 - DNA, 137 bp, Artificial
  Synthetic oligonucleotide
tacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccag

SEQ ID NO: 132 - DNA, 436 bp, Artificial
  Synthetic oligonucleotide
tctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaatc

SEQ ID NO: 133 - DNA, 669 bp, Artificial
  Synthetic oligonucleotide
ggagcggcctaggggaggccaggggcccacctgggctggggctgtggagagggagtggctgggacgggaggaaaaagagagacggagattagatggaagaagagggatttcaagacaaattgccagagatgcagtcagagagactgactgagagacacaaagatagaaggaattagagaaagggccacacagagccagacagagagagaagagtggagatggagacagggacgaggacagagaaaggcagacagacacatagggacagaaagagaaaaatcacacaaagtcagaattactgaatgacagggaatgacacatagaacgagacacagattcagagactcagggcagggaaaggaaggctgcagacagacagacagacagagggaggctgagacacagggagaagaggggcttggagaggtggcacaggcaggcagccagtgcctcagaggcctccggggagggccctcacacacaccccgccccggggcattaaggcagggcttggaggccagtcatcctgggcccgcccagggccgcccccctgccagcccgcctgcctggtgcctggcacctggcgctccaacccagcctacctgctgtagctgccgccactgccgtctccgccgccactgggcccccagagccccagccccagagcct

SEQ ID NO: 134 - DNA, 33 bp, Artificial
  Synthetic oligonucleotide
ggtgactccgggggccctctggtctgtaaccag

SEQ ID NO: 135 - DNA, 75 bp, Artificial
  Synthetic oligonucleotide
aggaacctggggcccgctcctcccccctccaggccatgaggattctgcagttaatcctgcttgctctggcaacag

SEQ ID NO: 136 - DNA, 359 bp, Artificial
  Synthetic oligonucleotide
cgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgt

SEQ ID NO: 137 - DNA, 586 bp, Artificial
  Synthetic oligonucleotide
ctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagactttctgaggttgtgctttatttctgctgcgtcgtgggagagggcgggagggtgtcaggggagagtctgcccaggcctcaagggcaggaaaagactccctaaggagctgcagtgcatgcaaggatattttgaatccagactggcacccacgtcacaggaaagcctaggaacactgtaagtgccgcttcctcgggaaagcagaaaaaatacatttcaggtagaagttttcaaaaatcacaagtctttcttggtgaagacagcaagccaataaaactgtcttccaaagtggtcctttatttcacaaccactctcgctactgttcaatacttgtactattcctgggttttgtttctttgtacagtaaacattatgaacaaacaggcaaa

SEQ ID NO: 138 - DNA, 111 bp, Artificial
  Synthetic oligonucleotide
ggaaagtgcatcttcctaagggcgagggtttcagcagtggttgaactcggcggggtggggcggagcgggaggatgcaaacttgcaaagtgaagcaaacacactcaccgcag

SEQ ID NO: 139 - DNA, 44 bp, Artificial
  Synthetic oligonucleotide
cccagcaagggctctggcagctgacagggctttgtctgggacag

SEQ ID NO: 140 - DNA, 97 bp, Artificial
  Synthetic oligonucleotide
ctgcaaaccagtgtgccgtgccagccaaggacagggtggactgcggctacccccatgtcacccccaaggagtgcaacaaccggggctgctgctttga

SEQ ID NO: 141 - DNA, 50 bp, Artificial
  Synthetic oligonucleotide
ctccaggatccctggagtgccttggtgtttcaagcccctgcaggaagcag

SEQ ID NO: 142 - DNA, 19 bp, Artificial
  Synthetic oligonucleotide
aatgcaccttctgaggcac

SEQ ID NO: 143 - DNA, 535 bp, Artificial
  Synthetic oligonucleotide
tctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccag

SEQ ID NO: 144 - DNA, 199 bp, Artificial
  Synthetic oligonucleotide
gttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccag

SEQ ID NO: 145 - DNA, 121 bp, Artificial
  Synthetic oligonucleotide
gtgcccttgaaagatgcgaagagctgtggcctccatcaactcctcagaggccctgaggtccagctggtggcccattcgccatggctaaaggactctctgtccagaacgacaaacatccagg

SEQ ID NO: 146 - DNA, 180 bp, Artificial
  Synthetic oligonucleotide
gccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctca

SEQ ID NO: 147 - DNA, 183 bp, Artificial
  Synthetic oligonucleotide
gtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatg

SEQ ID NO: 148 - DNA, 186 bp, Artificial
  Synthetic oligonucleotide
atcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaag

SEQ ID NO: 149 - DNA, 159 bp, Artificial
  Synthetic oligonucleotide
ctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaag

SEQ ID NO: 150 - DNA, 127 bp, Artificial
  Synthetic oligonucleotide
gtctttgaagctatgaacagctatgacctcggctgtggtcctgggggtggggacagtgcccttcaggtgttccaggcagcgggcctggccttttctgatggagaccagtggaccttatccagaaaga

SEQ ID NO: 151 - DNA, 198 bp, Artificial
  Synthetic oligonucleotide
tgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgag

SEQ ID NO: 152 - DNA, 258 bp, Artificial
  Synthetic oligonucleotide
gtgatgtcaccctgtctgggcctcaggtgaccctgcttccatttccctgtaccccagctccctgttccctttgctcttagtgtaggaagagggtccagtgatctggggaggtctgtgccagcgtgcagctggcgtgggccagagggcagaggcggactgagacagagctgggtcacccccacccctccctcctgtggccctgaagctttgatggcccctctgatctctgcccctgtgcccacgcttcctttccctcag

SEQ ID NO: 153 - DNA, 140 bp, Artificial
  Synthetic oligonucleotide
gcctatgtgtggccaccccagtccagctccgggtgttccgcgagttccacctgcacctccgcctgcccatgtctgtccgccgctttgagcagctggagctgcggcctgtcctctataactacctggataaaaacctgact

SEQ ID NO: 154 - DNA, 210 bp, Artificial
  Synthetic oligonucleotide
gtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgag

SEQ ID NO: 155 - DNA, 163 bp, Artificial
  Synthetic oligonucleotide
ggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaag

SEQ ID NO: 156 - DNA, 179 bp, Artificial
  Synthetic oligonucleotide
gttctgggtgcaagggcaagcaggaggggggccaggaaaggacagttactggaagatggacagcccaggaggctacagagggaaagaaagggggcccctgatgaggatggggagcatggccttgggctcaaacagcagaagggtgagtgtcacctgagcggccacctctcctctccaag

SEQ ID NO: 157 - DNA, 157 bp, Artificial
  Synthetic oligonucleotide
gctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcag

SEQ ID NO: 158 - DNA, 172 bp, Artificial
  Synthetic oligonucleotide
gaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggag

SEQ ID NO: 159 - DNA, 131 bp, Artificial
  Synthetic oligonucleotide
tgtggattgaaaccacagcctacgccctgctgcacctcctgcttcacgagggcaaagcagagatggcagaccaggctgcggcctggctcacccgtcagggcagcttccaagggggattccgcagtacccaa

SEQ ID NO: 160 - DNA, 393 bp, Artificial
  Synthetic oligonucleotide
gtgaaccactccctggtgaaccactccctcgcctgggtagccaggacacctgggcctcgtggccaggccagaagccgtccccaacctcccacccgtggaatccccgcagcacttcttcctggggtcttcgggggaagactgacttcctggctgcgtgacctggagctctgagcttcagttttctcacttgtagagtaacatacacagagttcaccctacagggtcgttagaaggctgaagtgagataattcatgtgctggtataaactttgtggaaatgtgaggtggggagaggaggtggggctgttttgaggaaggagataagttactggagccgcaaaaacaggtttgcttgtgcccttctaacatcgccttcccttttctgttgctgaag

SEQ ID NO: 161 - DNA, 1049 bp, Artificial
  Synthetic oligonucleotide
gtgagggccagggaaggggtggggccaggcactggtggaggagagggtgtggagtgagaggcctgtgggcagaggcacatggtccggggaaggaggcagacacctcagggttggtgtcccgtgcttccgtcctgggtgtttttccccctgcttgctttcgcttgctctccccatctctgggtacctgttgtttcctttacccgcctcagtgctggtggctccgaatcccactcctcagcccaggcctcttccctgaaccatgggccccactcgtcccactcccacagcacctcagacgaggcatgtcccaaagcccttcttcattctgtgtctcttgtctggctggtgggagcccctcccagccaggagcccagccactactctagaggccgtgttagtggcccctctcccaagcctgtccttatgtccctagtgactcctcctctgctcccctgctgcctgtggcccttggtgctgcatcctagattctgtgctgagacggccttctccctacctggaacttctctctacctcctgtctcccctgtctgatccactgtccacacggcagtgacactgaccttccaaaagccccagccagatcagccttggggaaaagtcactccccgctgcccacggctcagatggctgggcctctgcccacccctccggccagacagctctccttgtctacacagatccccttgcctttcctgtccttccctgcttcttggcccacaggacaagctctttcttctccttcaagccttggccagaagcctttcctgagcttttcagtccagcctcttcccagcacagtctggagtgttggcctctgggggcaggcccctgcttctttacctctctgtatgcgccgccgcctgtggcgaatgtggtgccactcgtgtgtgtggactgtgcagtgacggggaggaaaaggggctgaaggcctcaaatcccgtagcccagggagatgcccttaggtatggcaccagagaggtctgtggcctcacatgtcccacgtcctctccctgccccttgctgagccag

SEQ ID NO: 162 - DNA, 1482 bp, Artificial
  Synthetic oligonucleotide
gtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacg

SEQ ID NO: 163 - DNA, 165 bp, Artificial
  Synthetic oligonucleotide
gtgagcactgcaggacaccctgaaattcaggagaactttggcataggtgccctcctatgggacaatggacaccggggtagtgagggggcagagagccctggggctccctgggactgaggaggcagaatggaggggcctgtgccctaactcctctctgttctccag

SEQ ID NO: 164 - DNA, 182 bp, Artificial
  Synthetic oligonucleotide
gtcagtcttcccaccgaggccctggcctgaccctccctcggggaccggctgttttggtctctctgggtgtagcctgctcctcttacaggtcatgcacgcagcctgtttgctctgacaccaacttcctaccctctcagcctcaaagtaactcacctttcccccttctcctcaccccctcttag

SEQ ID NO: 165 - DNA, 262 bp, Artificial
  Synthetic oligonucleotide
gtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcag

SEQ ID NO: 166 - DNA, 133 bp, Artificial
  Synthetic oligonucleotide
ccaaggatgtcaaggccgctgctaatcagatgcgcaacttcctggttcgagcctcctgccgccttcgcttggaacctgggaaagaatatttgatcatgggtctggatggggccacctatgacctcgagggaca

SEQ ID NO: 167 - DNA, 143 bp, Artificial
  Synthetic oligonucleotide
gtgagtcatctggtcccctcagtctcttgtcctccccatgcctcgccacctaggccttgcccctcagaagccagatgcctgtgctctccgtttccacctgccatcctcccgagccctgctgactgcccctttgccccctgcag

SEQ ID NO: 168 - DNA, 150 bp, Artificial
  Synthetic oligonucleotide
cccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgcc

SEQ ID NO: 169 - DNA, 380 bp, Artificial
  Synthetic oligonucleotide
ggcatattaaaggcttttggcagcaaagtgtcagtgttggcagcgaagtgtcagtgtgtgttgctagggctgagagcagtgcccctgcccgatgcagttctgggcaggccaggttgacataaccttagactctctgagccctgatgacccttgggctgttcagctctgctagaacctcccagatgacccgctaggagtctagtgcttcacaggaccaccccgagcagaactgggacccaagagcctgcaccccaaggaccagagtccatgccaagaccacccttcagcttccaaggccctccactgcccggctgtcgccagtcaccacggcctcagacagggcttgtgctcagctgacacctgtgacacagctcttctgc

SEQ ID NO: 170 - DNA, 1146 bp, Artificial
  Synthetic oligonucleotide
ctcatgagctgttgtccagctacacctccccgactctgtcctcgtgctgctggcggttctgaggtctgcagattttagctgagttccgggctgttgaaagcctgctgacgcttggttctgttatcagtggaatgaggtgactttcccggagttgtgcaatcctcaggtccggcagtgtcttcttccagttactggtttcaaacaagccaaaagtctgactttggtgtgtttgtgaatcctctgaggaagccgctgttctcctggggtctccccttcccaccggacctgcctaactttcccccatttagtggcacacctggggtcttcagagatgactccgcgtctgtccaaagaagtttggtgagatcagtttccgtagaggtcatgacagttcagcagcctgccatccagtcattcgacagaaattcgggaatctttcacttcatgccatgccctgtgccaggtgccagagatacagctgctcactccagggctcatcgctggggagacagataagaggacgggcagtccccaccctctgtgaaagatgtgatgtcagggagcagtgtggtcctgtggggcatctaaccaagtcaggggcattgccaggcagggacagggaaggcttcctggagcaggtggcctccaagtggggctctgaagactgagaaggagccaggcaaagagcaggggtagatgagggcatctggggcagaaggagaatatacaaaggcccagaggccgggggcaggacagggtacctttggggacattgcatgtaattgaccacattcggagtttggatttggaagtggtggaagagatggagatggtgagacaagtagtaagcacgtcagccttccaggtgcgctcctttccgatgagcactgtcttatcccacgtaactttgagaagtttgggcctttcccactgtggcagaggtttcctgaggctcttgcatacatggccctatggttgctcatcagatctttctcccagtagctgctcagcatggtggtggcataagcccattttccggagccagggattcagttgcagcaagacatggcccggtctgggaggtcaaccatgaagaaggcagtagctgtcattgcccaaccccagaaatcccaatcctgttttctc

SEQ ID NO: 171 - DNA, 30 bp, Artificial
  Synthetic oligonucleotide
cttcttcaccttatctctgcagaagcccag

SEQ ID NO: 172 - DNA, 81 bp, Artificial
  Synthetic oligonucleotide
gtatcaacctgctcttctcctctcgccgggggcacctctttttgcagacggaccagcccatttacaaccctggccagcggg

SEQ ID NO: 173 - DNA, 71 bp, Artificial
  Synthetic oligonucleotide
ttcggtaccgggtctttgctctggatcagaagatgcgcccgagcactgacaccatcacagtcatggtggag

SEQ ID NO: 174 - DNA, 89 bp, Artificial
  Synthetic oligonucleotide
aactctcacggcctccgcgtgcggaagaaggaggtgtacatgccctcgtccatcttccaggatgactttgtgatcccagacatctcaga

SEQ ID NO: 175 - DNA, 83 bp, Artificial
  Synthetic oligonucleotide
gccagggacctggaagatctcagcccgattctcagatggcctggaatccaacagcagcacccagtttgaggtgaagaaatatg

SEQ ID NO: 176 - DNA, 97 bp, Artificial
  Synthetic oligonucleotide
tccttcccaactttgaggtgaagatcacccctggaaagccctacatcctgacggtgccaggccatcttgatgaaatgcagttagacatccaggccag

SEQ ID NO: 177 - DNA, 106 bp, Artificial
  Synthetic oligonucleotide
gtacatctatgggaagccagtgcagggggtggcatatgtgcgctttgggctcctagatgaggatggtaagaagactttctttcgggggctggagagtcagaccaag

SEQ ID NO: 178 - DNA, 27 bp, Artificial
  Synthetic oligonucleotide
ctggtgaatggacagagccacatttcc

SEQ ID NO: 179 - DNA, 106 bp, Artificial
  Synthetic oligonucleotide
ctctcaaaggcagagttccaggacgccctggagaagctgaatatgggcattactgacctccaggggctgcgcctctacgttgctgcagccatcattgagtctccag

SEQ ID NO: 180 - DNA, 116 bp, Artificial
  Synthetic oligonucleotide
gtggggagatggaggaggcagagctcacatcctggtattttgtgtcatctcccttctccttggatcttagcaagaccaagcgacaccttgtgcctggggcccccttcctgctgcag

SEQ ID NO: 181 - DNA, 99 bp, Artificial
  Synthetic oligonucleotide
gtttcttccagaggggaaggatgagtagggaggatgtggtagttaggagggctcagggtctgaccactctcttttgcctgccctcctttacctgcctag

SEQ ID NO: 182 - DNA, 75 bp, Artificial
  Synthetic oligonucleotide
gactaagctgtcccaaggagaagacaacccggaaaaagagaaacgtgaacttccaaaaggcgattaatgagaaat

SEQ ID NO: 183 - DNA, 112 bp, Artificial
  Synthetic oligonucleotide
ccctggagatcctgcaggaggaggacctgattgatgaggatgacattcccgtgcgcagcttcttcccagagaactggctctggagagtggaaacagtggaccgctttcaaat

SEQ ID NO: 184 - DNA, 71 bp, Artificial
  Synthetic oligonucleotide
attgacactgtggctccccgactctctgaccacgtgggagatccatggcctgagcctgtccaaaaccaaag

SEQ ID NO: 185 - DNA, 113 bp, Artificial
  Synthetic oligonucleotide
gtgaggccccataggagcctgagcatacaggagttgggggagccagggcccagtgaggggtggggaggctaaccgggccaggactctggccatcctcgttttcctgccctcag

SEQ ID NO: 186 - DNA, 52 bp, Artificial
  Synthetic oligonucleotide
aaggaaggggccatccatagagaggagctggtctatgaactcaaccccttgg

SEQ ID NO: 187 - DNA, 90 bp, Artificial
  Synthetic oligonucleotide
accaccgaggccggaccttggaaatacctggcaactctgatcccaatatgatccctgatggggactttaacagctacgtcagggttacag

SEQ ID NO: 188 - DNA, 47 bp, Artificial
  Synthetic oligonucleotide
cctcagatccattggacactttaggctctgagggggccttgtcacca

SEQ ID NO: 189 - DNA, 76 bp, Artificial
  Synthetic oligonucleotide
gctacatgcggatccagcagtttcggaaggcggatggttcctatgcggcttggttgtcacgggacagcagcacctg

SEQ ID NO: 190 - DNA, 117 bp, Artificial
  Synthetic oligonucleotide
gggggtttggtgggcaatgatgagactgtggcactcacagcctttgtgaccatcgcccttcatcatgggctggccgtcttccaggatgagggtgcagagccattgaagcagagagtg

SEQ ID NO: 191 - DNA, 20 bp, Artificial
  Synthetic oligonucleotide
ataacctgtactggggctca

SEQ ID NO: 192 - DNA, 40 bp, Artificial
  Synthetic oligonucleotide
gtcactggttctcagagcaatgccgtgtcgcccaccccgg

SEQ ID NO: 193 - DNA, 42 bp, Artificial
  Synthetic oligonucleotide
ctcctcgcaacccatccgaccccatgccccaggccccagccc

SEQ ID NO: 194 - DNA, 82 bp, Artificial
  Synthetic oligonucleotide
gtaggggccgtccccgggctctggcgggggtgggtagtcctcagaccaagggcttgcttgagtcctggctcaacctccctag

SEQ ID NO: 195 - DNA, 24 bp, Artificial
  Synthetic oligonucleotide
gacacggtgattgccctggatgcc

SEQ ID NO: 196 - DNA, 80 bp, Artificial
  Synthetic oligonucleotide
ctgtctgcctactggattgcctcccacaccactgaggagaggggtctcaatgtgactctcagctccacaggccggaatgg

SEQ ID NO: 197 - DNA, 64 bp, Artificial
  Synthetic oligonucleotide
gttcaagtcccacgcgctgcagctgaacaaccgccagattcgcggcctggaggaggagctgcag

SEQ ID NO: 198 - DNA, 60 bp, Artificial
  Synthetic oligonucleotide
ttttccttgggcagcaagatcaatgtgaaggtgggaggaaacagcaaaggaaccctgaag

SEQ ID NO: 199 - DNA, 94 bp, Artificial
  Synthetic oligonucleotide
gtccttcgtacctacaatgtcctggacatgaagaacacgacctgccaggacctacagatagaagtgacagtcaaaggccacgtcgagtacacga

SEQ ID NO: 200 - DNA, 11 bp, Artificial
  Synthetic oligonucleotide
tggaagcaaac

SEQ ID NO: 201 - DNA, 116 bp, Artificial
  Synthetic oligonucleotide
gaggactatgaggactatgagtacgatgagcttccagccaaggatgacccagatgcccctctgcagcccgtgacacccctgcagctgtttgagggtcggaggaaccgccgcaggag

SEQ ID NO: 202 - DNA, 13 bp, Artificial
  Synthetic oligonucleotide
ggaggcgcccaag

SEQ ID NO: 203 - DNA, 47 bp, Artificial
  Synthetic oligonucleotide
gtggtggaggagcaggagtccagggtgcactacaccgtgtgcatctg

SEQ ID NO: 204 - DNA, 114 bp, Artificial
  Synthetic oligonucleotide
gtgggcgccgggagctgccctgggccaggggagggagggcaggacccaggctggggctgggcttctggagcccgcgcaggcagaacctggacgacagctcacacgtctccacag

SEQ ID NO: 205 - DNA, 91 bp, Artificial
  Synthetic oligonucleotide
gcggaacggcaaggtggggctgtctggcatggccatcgcggacgtcaccctcctgagtggattccacgccctgcgtgctgacctggagaag

SEQ ID NO: 206 - DNA, 90 bp, Artificial
  Synthetic oligonucleotide
gtgtggtcagccacccagggcaaccccctctgtcccaggtactgagccctgtcatgtgcagggcctgtgaccaactccccttttccacag

SEQ ID NO: 207 - DNA, 9 bp, Artificial
  Synthetic oligonucleotide
ctgacctcc

SEQ ID NO: 208 - DNA, 11 bp, Artificial
  Synthetic oligonucleotide
ctctctgaccg

SEQ ID NO: 209 - DNA, 37 bp, Artificial
  Synthetic oligonucleotide
ttacgtgagtcactttgagaccgaggggccccacgtc

SEQ ID NO: 210 - DNA, 18 bp, Artificial
  Synthetic oligonucleotide
ctgctgtattttgactcg

SEQ ID NO: 211 - DNA, 9 bp, Artificial
  Synthetic oligonucleotide
cttggccag

SEQ ID NO: 212 - DNA, 8 bp, Artificial
  Synthetic oligonucleotide
gtccccac

SEQ ID NO: 213 - DNA, 17 bp, Artificial
  Synthetic oligonucleotide
ctcccgggagtgcgtgg

SEQ ID NO: 214 - DNA, 49 bp, Artificial
  Synthetic oligonucleotide
gctttgaggctgtgcaggaagtgccggtggggctggtgcagccggccag

SEQ ID NO: 215 - DNA, 29 bp, Artificial
  Synthetic oligonucleotide
cgcaaccctgtacgactactacaaccccg

SEQ ID NO: 216 - DNA, 90 bp, Artificial
  Synthetic oligonucleotide
agcgcagatgttctgtgttttacggggcaccaagtaagagcagactcttggccaccttgtgttctgctgaagtctgccagtgtgctgagg

SEQ ID NO: 217 - DNA, 85 bp, Artificial
  Synthetic oligonucleotide
gtgagactgagggcctggggcggggcagtggaggcgggatggccggggccccccccacactgtctgatgggttccccaacttcag

SEQ ID NO: 218 - DNA, 73 bp, Artificial
  Synthetic oligonucleotide
ggaagtgccctcgccagcgtcgcgccctggagcggggtctgcaggacgaggatggctacaggatgaagtttgc

SEQ ID NO: 219 - DNA, 26 bp, Artificial
  Synthetic oligonucleotide
ctgctactacccccgtgtggagtacg

SEQ ID NO: 220 - DNA, 84 bp, Artificial
  Synthetic oligonucleotide
gcttccaggttaaggttctccgagaagacagcagagctgctttccgcctctttgagaccaagatcacccaagtcctgcacttca

SEQ ID NO: 221 - DNA, 91 bp, Artificial
  Synthetic oligonucleotide
ctcccacctccgctgggaggaacctgaacctgggaaccatgaagctggaagcactgctgtgtccgctttcatgaacacagcctgggaccag

SEQ ID NO: 222 - DNA, 131 bp, Artificial
  Synthetic oligonucleotide
caagcccagcagccccggggcggatggctccggccgcctggctccgcagcgcggccgcgcgcgccctcctgcccccgatgctgctgctgctgctccagccgccgccgctgctggcccgggctctgccgccg

SEQ ID NO: 223 - DNA, 182 bp, Artificial
  Synthetic oligonucleotide
gacgtccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagag

SEQ ID NO: 224 - DNA, 144 bp, Artificial
  Synthetic oligonucleotide
gatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccag

SEQ ID NO: 225 - DNA, 134 bp, Artificial
  Synthetic oligonucleotide
gtactggcatggggacgacctgccgtttgatgggcctgggggcatcctggcccatgccttcttccccaagactcaccgagaaggggatgtccacttcgactatgatgagacctggactatcggggatgaccagg

SEQ ID NO: 226 - DNA, 183 bp, Artificial
  Synthetic oligonucleotide
acaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggag

SEQ ID NO: 227 - DNA, 217 bp, Artificial
  Synthetic oligonucleotide
ccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaag

SEQ ID NO: 228 - DNA, 138 bp, Artificial
  Synthetic oligonucleotide
agctgggatttccatcctcaactggcagagatgagagcctggagcattgcagatgccagggacttcacaaatgaaggcacagcatgggaaacctgcgtgggttccagggcagtccagcctgcaggggcccagggagtg

SEQ ID NO: 229 - DNA, 300 bp, Artificial
  Synthetic oligonucleotide
gtcagtaggcatttgtcacagccaaatgccagtggaaggagcagccgcccaggcagccctctactgatgagagtaacctcacccgtgcactagtttacagagcattcactgccccagcttatcccaggcctcccgcttccctctgcgggtggggtgctgagcaggcattattggcctgcatgttttactgatgaggaaactgaggctgggagagtctgtggtaggggtcaagcaggtccacagtggcggggcatggcagtggtggctgggcaggtccttgcagccttccctctccggcag

SEQ ID NO: 230 - DNA, 142 bp, Artificial
  Synthetic oligonucleotide
gtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcag

SEQ ID NO: 231 - DNA, 927 bp, Artificial
  Synthetic oligonucleotide
gtgcgttgggggtgaggcagctggtgggaggtgggcacagcagccgcttctcccacctggtggtggctgggctcccacatgcctgccacaggaagtctggctcttcatcacaggtcctttgtccagagccatctgccctcctctcggtggccggctagtgctacattccatattgcagatgaggaaactgagggtcagagaagtgcaaggtcttaccctggtttttcagccacagccagtagaacaataaactgctgtacactgagggccaacaatgctctaagctccttactggtctcatccagttctcagaacagccctctgatgtgacacctgttgtgaacccagtttccagaggagcaaacagaggctcaggcaatgaggcccctaacctggactaccctggtggtccctgctcctaaccactgacccacccagcctcccacaaccacagggggctagagccagtccagtgctccctcccctgctaggctcctcttctgtgctctttctcccacatcaggacccactgggagagctatcctagggtagcctccagctccaggactccagggtgcccgtcaatagcctggctaatttaatagatgcaggagagagtgatgtggagggtggtgggggcaacgggacttgctttcctgagaggtgggactcaggcctctgaggctctgggtacctgtcaggctgggtattagcccagcccagattccggggcaggcagaagggctccctagagggaagagaggttctgaaaggccggccctggatcctgcaggactcgaggaactcagcagtggccaagggcttcccactcagccctcccttagtgcccatccctgggcacagcctgacaggcaggagtagggcccagtgtccactcgcccaggcttgaccaccttctcttctcag

SEQ ID NO: 232 - DNA, 911 bp, Artificial
  Synthetic oligonucleotide
gctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttctacctgcc

SEQ ID NO: 233 - DNA, 48 bp, Artificial
  Synthetic oligonucleotide
gttcgtgctttctggcgggcgctgggagaagacggacctcacctacag

SEQ ID NO: 234 - DNA, 41 bp, Artificial
  Synthetic oligonucleotide
gcacagacctgctgcaggtggcagcccatgaatttggccac

SEQ ID NO: 235 - DNA, 18 bp, Artificial
  Synthetic oligonucleotide
gtgctggggctgcagcac

SEQ ID NO: 236 - DNA, 92 bp, Artificial
  Synthetic oligonucleotide
gtgaggccctgcctgccagtccccctactcctctgctggccactgtgactgcagcatatgccctcagcatgtgtccctctctcccaccccag

SEQ ID NO: 237 - DNA, 116 bp, Artificial
  Synthetic oligonucleotide
ggactactggcgtttccaccccagcacccggcgtgtagacagtcccgtgccccgcagggccactgactggagaggggtgccctctgagatcgacgctgccttccaggatgctgatg

SEQ ID NO: 238 - DNA, 340 bp, Artificial
  Synthetic oligonucleotide
cggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaag

SEQ ID NO: 239 - DNA, 123 bp, Artificial
  Synthetic oligonucleotide
gacttcttgggcctactttatatgctgaagtcggagacatcataaaagttcactttaaaaataaggcagataagcccttgagcatccatcctcaaggaattaggtacagtaaattatcagaag

SEQ ID NO: 240 - DNA, 213 bp, Artificial
  Synthetic oligonucleotide
gtgcttcttaccttgaccacacattccctgcggagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaag

SEQ ID NO: 241 - DNA, 144 bp, Artificial
  Synthetic oligonucleotide
ggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccag

SEQ ID NO: 242 - DNA, 222 bp, Artificial
  Synthetic oligonucleotide
atataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaag

SEQ ID NO: 243 - DNA, 166 bp, Artificial
  Synthetic oligonucleotide
ctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaa

SEQ ID NO: 244 - DNA, 178 bp, Artificial
  Synthetic oligonucleotide
aaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaa

SEQ ID NO: 245 - DNA, 215 bp, Artificial
  Synthetic oligonucleotide
gcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacag

SEQ ID NO: 246 - DNA, 151 bp, Artificial
  Synthetic oligonucleotide
agggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagca

SEQ ID NO: 247 - DNA, 153 bp, Artificial
  Synthetic oligonucleotide
gtaagtcagagtactatttttgttcatcagtttttcattcctgtggttgaaatatgactgtgcctagagtcagagacatggattaaaatctactcgctaaggggcacctccaatcctcacttccagtccaaagacttggtgatgaaatccgtg

SEQ ID NO: 248 - DNA, 213 bp, Artificial
  Synthetic oligonucleotide
ctatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttg

SEQ ID NO: 249 - DNA, 1609 bp, Artificial
  Synthetic oligonucleotide
gaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaattaggtcattccgaaactcatcattgaaccaggaagaagaagagttcaatcttactgccctagctctggagaatggcactgaattcgtttcttcgaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcagaagtcaagaacatgctaagcgtaagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccct

SEQ ID NO: 250 - DNA, 170 bp, Artificial
  Synthetic oligonucleotide
ctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttag

SEQ ID NO: 251 - DNA, 1042 bp, Artificial
  Synthetic oligonucleotide
acctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaag

SEQ ID NO: 252 - DNA, 237 bp, Artificial
  Synthetic oligonucleotide
gttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaaccca

SEQ ID NO: 253 - DNA, 211 bp, Artificial
  Synthetic oligonucleotide
gaaaaagatattcactcaggcttgataggtcccctcctaatctgccaaaaaggaatactacataaggacagcaacatgcctgtggacatgagagaatttgtcttactatttatgacctttgatgaaaagaagagctggtactatgaaaagaagtcccgaagttcttggagactcacatcctcagaaatgaaaaaatcccatgagtttcacg

SEQ ID NO: 254 - DNA, 180 bp, Artificial
  Synthetic oligonucleotide
ccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctg

SEQ ID NO: 255 - DNA, 156 bp, Artificial
  Synthetic oligonucleotide
gtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatg

SEQ ID NO: 256 - DNA, 138 bp, Artificial
  Synthetic oligonucleotide
tattttaatggcaattcagatgcctctacaataaaagagaatcagtttgacccacctattgtggctagatatattaggatctctccaactcgagcctataacagacctacccttcgattggaactgcaaggttgtgag

SEQ ID NO: 257 - DNA, 152 bp, Artificial
  Synthetic oligonucleotide
gatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaag

SEQ ID NO: 258 - DNA, 136 bp, Artificial
  Synthetic oligonucleotide
gcaaacaacaataagcagtggctagaaattgatctactcaagatcaagaagataacggcaattataacacagggctgcaagtctctgtcctctgaaatgtatgtaaagagctataccatccactacagtgagcagg

SEQ ID NO: 259 - DNA, 1180 bp, Artificial
  Synthetic oligonucleotide
aaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaagaagcttttataatgtaactccttgctaccagtaagtaagataatggctattacttctgcattaatttgaatacaggtaggaaaatatcaagaaccaacaagaaaagggcttatctttcttaatgattgaaaatgctatgaagtaatatttatgtagttaaaatgcttcattataactcttttaaatcctttacacactagtaaaacagatattactttaaataataattgatagacctggataactttcacaaacacatgattttttaatggtttttcttgagtgaagagaaaaacaatattatcaaatgaaataagtacttaaaatatcctgtctttcccatataacaatgatttttctgactttccatgagtaaaaaaacagccaagcatctttccagtagccccattgaaattgtgaatccgtcctggtctccctaaggactgcacacattgatattcaaggttggtggtcattagatatggaacagaactgaaataaccatggtagaactgaatgtgtaatgttggctttattctagctggtactacatggcacacagtttcaaaacataatttcacctactggaaagctcagacctgtaaaacagagcatgggaactgctggtctaaatgcagttgttcctgctcaaagagacctctggccaaactggcaagcagttaaagttttctttcagggccttcctctctatggcctcaacttcctcctctctcttcttccagcaacttcccctttcatcattcctttccctggggacttggcattcagtgatcctgtagatattgcacaactggggaacctttagacatccttaaaatcacatgagatagacagtcatttggggtgtctgaaataaaccaccccaaaacttagt

SEQ ID NO: 260 - DNA, 92 bp, Artificial
  Synthetic oligonucleotide
tttgaatctttctgtaacttcctttaagaaaattgtctacagagagtatgaaccatattttaagaaagaaaaaccacaatctaccatttcag

SEQ ID NO: 261 - DNA, 100 bp, Artificial
  Synthetic oligonucleotide
atcgtgttcaaaaatatggccagccgcccctatagcatttaccctcatggagtgaccttctcgccttatgaagatgaagtcaactcttctttcacctcag

SEQ ID NO: 262 - DNA, 55 bp, Artificial
  Synthetic oligonucleotide
ggaaacagatattgaagactctgatgatattccagaagataccacatataagaaa

SEQ ID NO: 263 - DNA, 52 bp, Artificial
  Synthetic oligonucleotide
gtagtttttcgaaagtacctcgacagcacttttaccaaacgtgatcctcgag

SEQ ID NO: 264 - DNA, 68 bp, Artificial
  Synthetic oligonucleotide
gggagtatgaagagcatctcggaattcttggtcctattatcagagctgaagtggatgatgttatccaa

SEQ ID NO: 265 - DNA, 117 bp, Artificial
  Synthetic oligonucleotide
gttcatttaaaactcttgaaatgaaggcatcaaaacctggctggtggctcctaaacacagaggttggagaaaaccagagagcagggatgcaaacgccatttcttatcatggacagag

SEQ ID NO: 266 - DNA, 72 bp, Artificial
  Synthetic oligonucleotide
actgtaggatgccaatgggactaagcactggtatcatatctgattcacagatcaaggcttcagagtttctgg

SEQ ID NO: 267 - DNA, 104 bp, Artificial
  Synthetic oligonucleotide
gttactgggagcccagattagcaagattaaacaatggtggatcttataatgcttggagtgtagaaaaacttgcagcagaatttgcctctaaaccttggatccag

SEQ ID NO: 268 - DNA, 7 bp, Artificial
  Synthetic oligonucleotide
gtaaatg

SEQ ID NO: 269 - DNA, 47 bp, Artificial
  Synthetic oligonucleotide
gagtggaatggaaaccatacaggctgaaatcctccatggtggacaag

SEQ ID NO: 270 - DNA, 7 bp, Artificial
  Synthetic oligonucleotide
atttttg

SEQ ID NO: 271 - DNA, 317 bp, Artificial
  Synthetic oligonucleotide
gcaggcgcggcggcggcggcggaggcggaggcggccccgggctcgggcggctgggatggagcagaagagcgcggagcaccggagggcacgcagctgacggagctgcgctgcgttcgcctcgtttgcctcgcgccctccactggagctgttcgcgcctcccggctcccaccgcagcccacccggcagaggagtcgctaccagcgcccagtgcgctctgtcagtccgcaaactccttgccgcccgccccgggctgggcaccaaataccaggctaccatggtctacaagactctcttcgctctttgcatcttaactgcag

SEQ ID NO: 272 - DNA, 237 bp, Artificial
  Synthetic oligonucleotide
gatggagggtacagagtctgcctacatcagctcctttgtctgtttctcttccgacaaacattgtaccaccgaccaccatctggactagctctccacaaaacactgatgcagacactgcctccccatccaacggcactcacaacaactcggtgctcccagttacagcatcagccccaacatctctgcttcctaagaacatttccatagagtccagagaagaggagatcaccagcccag

SEQ ID NO: 273 - DNA, 489 bp, Artificial
  Synthetic oligonucleotide
gttcgaattgggaaggcacaaacacagacccctcaccttctgggttctcgtcaacaagcggtggagtccacttaacaaccacgttggaggaacacagctcgggcactcctgaagcaggcgtggcagctacactgtcgcagtccgctgctgagcctcccacactcatctcccctcaagctccagcctcatcaccctcatccctatcaacctcaccacctgaggtcttttctgcctccgttactaccaaccatagctccactgtgaccagcacccaacccactggagctccaactgcaccagagtccccgacagaggagtccagctctgaccacacacccacttcacatgccacagctgagccagtaccccaggagaaaacacccccaacaactgtgtcaggcaaagtgatgtgtgagctcatagacatggagaccaccaccacctttcccagggtgatcatgcaggaagtagaacatgcattaagttcag

SEQ ID NO: 274 - DNA, 399 bp, Artificial
  Synthetic oligonucleotide
gcattcctcctatggaagacttttggacgaccatgactacgggtcctggggaaactacaacaaccctctgtacgatgactcctaacaatggaatatggcctgggatgaggattaactgttctttatttataagtgcttatccagtagaattaataagtacctgatgcgcattgaacgacaatcttaagccctgttttgttggtatggttgtttttgttttcctccctctcctctggctgctacaacttcccctttctggtacaagaagaaccattctttaaaggtgagtggaggctgatttgcagctgaagtgggccagccttgcaccagccaggccagaccaccatggtgaaggcttctttccccactgcaggacccactttgagaaggaccgaggag

SEQ ID NO: 275 - DNA, 181 bp, Artificial
  Synthetic oligonucleotide
cttctatttaggaaattacattaagtattaatgaggggaaaggaaatgagctctacgaggatttcaccctgcatgggagagagcagggttttctcagattcctttttaatctctatttatctggttgtttctgacaggatgctgcctgcttggctctacaagctggaaagcagcttcttag

SEQ ID NO: 276 - DNA, 300 bp, Artificial
  Synthetic oligonucleotide
ctgcctaattaatgaaagatgaaaataggaagtgccctggagggggccagcaggtcacggggcagaatctctcaggttgctgtgggatctcagtgtgcccctacctgttctcccctccaggccacctgtctctgtaaaggatgtctgctctgttcaaaaggcagctgggatcccagcccacaagtgatcagcagagttgcatttccaaagaaaaaggctatgagatgagctgagttatagagagaaagggagaggcatgtacggtgtggggaagtggaagagaagctggcgggggagaag

SEQ ID NO: 277 - DNA, 331 bp, Artificial
  Synthetic oligonucleotide
gaggctaacctgcactgagtacttcattaggacaagtgagaatcagctattgataatggccagagatatccacagcttggaggagcccagagaccgtttgctttatacccacacagcaactggtccactgctttactgtctgttggataatggctgtaaaatgtttaaaaacaaaacaaaacaaaaaagaggcactagtctatctgcaattactcaacgaggcattttcataggaaacagactatgattaatccatttattcttcccacacacttaccttactaagtctttgctttaataaatgagcaaccctgggtatagtcttaaaatt

SEQ ID NO: 278 - DNA, 1377 bp, Artificial
  Synthetic oligonucleotide
ctgcacaataaattttgagaaagaattgttcctctttgtaggtatctgtgtattgcaatcattctcaaccaggaggtgattttgccccctgactccaccccagggacattcaaaaatgtctggtgacagttttcattgtcatgacttgggggtgctactagaggccaggaatgctgccaaacattctaccatgcacagcacaacctacaacagcaaagaatcatccaccccaaaatatcagtagtgccgagattgagaaaccctgatttatcacaatgcccactgtgacagaacaagacactcacagattagtgatacgttttatttttaacaaaatgaaatgatgtgttaagtttttatttccaaagtgtttagtttattggctgatgggttgttcttggtatgcatggtgacctttttatttctgtgtgcttcctagagagctttatttcatggcgacaactctgtcttcttgtaacagctgatattagcaagcagcatcttatgtcctgatttcatatagtagaaaacaaacattgggtccgacttcaaaatgtgttgtattgtcctacagtgtcataaagaacctgaaaatgaacttttgtttctaaagttggaccttgctgccatgactgtttagtttacagaaacttgaccccggctcatcctgtctctggctgtggcccggcaaagcactgaaaacccctctggtctcagagacagtaggggcagtgccactttctacaacctgccaacccacacactggagtaattctgaaaaaaattattcctaaactctctaagtgtggacggagaatgagcaagccccagaagtattttacaaccagagtgggtaatgaggagggggcttactggaatcgtcatatctctgaatattgaaaacaacaactaaaaaagtggaccttctcagaaaaaaagggcagcaaatgaccaagggcgccccttctggccgtgcttggcttgagtaactgtctctctttccccacccccatcacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaaccgtgaactcaagcaggcattttttttttcttaccgaaaggctgctattgtgcaagggcacataatgggtctgttgctcttattggcttccaaatgtgcatggcaaagagagagatgtgggcctagagcagatatattcagcaaggtgacagcttcccataacaatt

SEQ ID NO: 279 - DNA, 272 bp, Artificial
  Synthetic oligonucleotide
ctaacacttcttatcttatgtgagaataaaatatttaagggttgaaccttattttgccaaatgtatcttttctgcttttgaattgggcagaagattttagcaactatattctacaaatgttacttataacacacacacacacatctgaaatatatgccgaaaattgacgtctttgacctcagggagagcacctgtccaggtctgcctaaaggaaatggctccagtgggtctaaacaaccacatcctatccatggataggtctagtcataaca

SEQ ID NO: 280 - DNA, 516 bp, Artificial
  Synthetic oligonucleotide
ggaggcaagccgcctcttctcggccatcaactgcagatgatgaaagagcgggattcaactttgttttcttttcctgtggccccagtgaaacctcctgccctccctgcacgtctgtgtcttcatttctaaaatgggggtgatgctttcatattgacctcaccccatactacctcacagatgtgttgtgaggattaataaaattatgtctatggtattttcagtttctggagaaaaatacttatagacagtttaactattacatagatatataagtgatctcagtttcttgtttgctgtgatactaatgtgttgttttaacttattccataaaatgacagttgtgtcctagccacatcagacagctatctaagctctggactacccctttgtgcagctgaatcactgcagggttgaccatgcctggtgccacagccatggtttccatttctagatgaaaggatggcctaggacataggtctcaaagactcttggatcagaatcaggagattagggaaa

SEQ ID NO: 281 - DNA, 429 bp, Artificial
  Synthetic oligonucleotide
catctgaggtcttctggattctttgtggggttaattttgatttgatgtcatctgtttgcccttcatcttgcttgcaagtgtgcatggttcaatccctcacatccaggaaatgaattttgcaattgggccagatgctaatttgcacgttgattcaccttctttgcctttaagccttttttttcttttttttttttttggcaaatgaatgtaccatttcaactttgattttaatagtgctagttgatattggtaataatgctaaccaagagatcaatgccagatttttctcttggggtaagttagctgaagtcatttaaagatggaaaggtgggaaaattctttgatatttgatgtcattgtatccacatttgttgtaagacatattgcataccaattataattatatcaattaaagttgataaaagcttc

SEQ ID NO: 282 - DNA, 66 bp, Artificial
  Synthetic oligonucleotide
gaggatttgggttgttttgttaggggttactttcaggggaacatttcatttgtgttatttcttaaa

SEQ ID NO: 283 - DNA, 26 bp, Artificial
  Synthetic oligonucleotide
ctttagagagaatgtcagagcaggag

SEQ ID NO: 284 - DNA, 54 bp, Artificial
  Synthetic oligonucleotide
acaggatggatacctgagcactaacagcagtagacgtagacctctgtcctttac

SEQ ID NO: 285 - DNA, 248 bp, Artificial
  Synthetic oligonucleotide
gccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagc

SEQ ID NO: 286 - DNA, 285 bp, Artificial
  Synthetic oligonucleotide
cacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatcc

SEQ ID NO: 287 - DNA, 265 bp, Artificial
  Synthetic oligonucleotide
gtgcgcagcgacgtgaagccggtgatccagtggctgaagcgcgtggagtacggcgccgagggccgccacaactccaccatcgatgtgggcggccagaagtttgtggtgctgcccacgggtgacgtgtggtcgcggcccgacggctcctacctcaataagctgctcatcacccgtgcccgccaggacgatgcgggcatgtacatctgccttggcgccaacaccatgggctacagcttccgcagcgccttcctcaccgtgctgccag

SEQ ID NO: 288 - DNA, 240 bp, Artificial
  Synthetic oligonucleotide
gtgcgcggctgccacgccacgccacaccatgctggtgcccggacccgccccctgggcccggcgtcccacccaccgggtggggccccacccttccctcccgggccgtgctggccaggtcatctgccgagggagggcagcccaggggcaccgtctccacagcccctgggatgggtctggggtgctctcctggtctttgtgtcggcgttcccctccctacctcctttcctctcgctcttgcag

SEQ ID NO: 289 - DNA, 900 bp, Artificial
  Synthetic oligonucleotide
acccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactacctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacag

SEQ ID NO: 290 - DNA, 471 bp, Artificial
  Synthetic oligonucleotide
gcagatatgctgcctggacacacacacagataatgctgcctcaacactcacacacgtgcagatattgcctggacacacacatgtgcacagatatgctgtctggacatgcacacacgtgcagatatgctgtccggatacacacgcacgcacacatgcagatatgctgcctgggcacacacttccggacacacatgcacacacaggtgcagatatgctgcctggacacacgcagactgacgtgcttttgggagggtgtgccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacag

SEQ ID NO: 291 - DNA, 171 bp, Artificial
  Synthetic oligonucleotide
cagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgg

SEQ ID NO: 292 - DNA, 174 bp, Artificial
  Synthetic oligonucleotide
gacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctcca

SEQ ID NO: 293 - DNA, 55 bp, Artificial
  Synthetic oligonucleotide
gtccggacaggccgagatgacgccgagccccctgttgctgctcctgctgccgccg

SEQ ID NO: 294 - DNA, 40 bp, Artificial
  Synthetic oligonucleotide
ctgctgctgggggccttcccgccggccgccgccgcccgag

SEQ ID NO: 295 - DNA, 25 bp, Artificial
  Synthetic oligonucleotide
gtcaactacaccctcgtcgtgctgg

SEQ ID NO: 296 - DNA, 51 bp, Artificial
  Synthetic oligonucleotide
atgacattagcccagggaaggagagcctggggcccgacagctcctctgggg

SEQ ID NO: 297 - DNA, 30 bp, Artificial
  Synthetic oligonucleotide
gtcaagaggaccccgccagccagcagtggg

SEQ ID NO: 298 - DNA, 89 bp, Artificial
  Synthetic oligonucleotide
agcggacccgttccaagcccgtgctcacaggcacgcaccccgtgaacacgacggtggacttcggggggaccacgtccttccagtgcaag

SEQ ID NO: 299 - DNA, 78 bp, Artificial
  Synthetic oligonucleotide
atatgctgcctggacacacagataatgctgccttgacacacacatgcacggatattgcctggacacacacacacacac

SEQ ID NO: 300 - DNA, 90 bp, Artificial
  Synthetic oligonucleotide
gcgtgcacagatatgctgtctggacacgcacacacatgcagatatgctgcctggacacacacttccagacacacgtgcacaggcgcagat

SEQ ID NO: 301 - DNA, 46 bp, Artificial
  Synthetic oligonucleotide
atgctgcctggacacacgcagatatgctgtctagtcacacacacac

SEQ ID NO: 302 - DNA, 27 bp, Artificial
  Synthetic oligonucleotide
gcagacatgctgtccggacacacacac

SEQ ID NO: 303 - DNA, 29 bp, Artificial
  Synthetic oligonucleotide
gcatgcacagatatgctgtccggacacac

SEQ ID NO: 304 - DNA, 8 bp, Artificial
  Synthetic oligonucleotide
acacgcac

SEQ ID NO: 305 - DNA, 564 bp, Artificial
  Synthetic oligonucleotide
ttctcggccccgctctgcttcagtggacccggggagggcggggaagtggagtgggagacctaggggtgggcttcccgaccttgctgtacaggacctcgacctagctggctttgttccccatccccacgttagttgttgccctgaggctaaaactagagcccaggggccccaagttccagactgcccctcccccctcccccggagccagggagtggttggtgaaagggggaggccagctggagaacaaacgggtagtcagggggttgagcgattagagcccttgtaccctacccaggaatggttggggaggaggaggaagaggtaggaggtaggggagggggcggggttttgtcacctgtcacctgctccggctgtgcctagggcgggcgggcggggagtggggggaccggtataaagcggtaggcgcctgtgcccgctccacctctcaagcagccagcgcctgcctgaatctgttctgccccctccccacccatttcaccaccaccatgacaccgggcacccagtctcctttcttcctgctgctgctcctcacagtgcttacag

SEQ ID NO: 306 - DNA, 176 bp, Artificial
  Synthetic oligonucleotide
gctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacg

SEQ ID NO: 307 - DNA, 132 bp, Artificial
  Synthetic oligonucleotide
gatctgtggtggtacaattgactctggccttccgagaaggtaccatcaatgtccacgacgtggagacacagttcaatcagtataaaacggaagcagcctctcgatataacctgacgatctcagacgtcagcg

SEQ ID NO: 308 - DNA, 140 bp, Artificial
  Synthetic oligonucleotide
gctgtctgtcagtgccgccgaaagaactacgggcagctggacatctttccagcccgggatacctaccatcctatgagcgagtaccccacctaccacacccatgggcgctatgtgccccctagcagtaccgatcgtagccc

SEQ ID NO: 309 - DNA, 524 bp, Artificial
  Synthetic oligonucleotide
gtgagcgtgggtgccagtggggttcttgggagcttcaaggaagcaaggaacgctccctccttcctctcctggtctttctctatgggacctagtaaataattactgcagccacctgaggctggaaaaccactccaggtgggggaggagagagtttagttttcttgctcctattttcctcctcctggagacctccctctctcggctttacaaagacacagatacaccccgccccccaaaacacacacacacacacacacacacacacctccttaggctggaacagcagagaatggagggacaagggggctgattagagccaagaagagggagtgaaggagagcagagggaggagggcagccctgtttacagtcacctggctggtggggtggcaggtgctctctctgaattaaccctttgagagctggccaggactctggactgattaccccagcctggggtggcatccaggggctctaggaggtaccttttgctcctcaccctggatctcttttccttccacccag

SEQ ID NO: 310 - DNA, 262 bp, Artificial
  Synthetic oligonucleotide
ttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaaaaaaaaa

SEQ ID NO: 311 - DNA, 27 bp, Artificial
  Synthetic oligonucleotide
ctaccacagcccctaaacccgcaacag

SEQ ID NO: 312 - DNA, 9 bp, Artificial
  Synthetic oligonucleotide
ttgttacag

SEQ ID NO: 313 - DNA, 27 bp, Artificial
  Synthetic oligonucleotide
gttctggtcatgcaagctctaccccag

SEQ ID NO: 314 - DNA, 38 bp, Artificial
  Synthetic oligonucleotide
gtggagaaaaggagacttcggctacccagagaagttca

SEQ ID NO: 315 - DNA, 27 bp, Artificial
  Synthetic oligonucleotide
gtgcccagctctactgagaagaatgct

SEQ ID NO: 316 - DNA, 19 bp, Artificial
  Synthetic oligonucleotide
tttaattcctctctggaag

SEQ ID NO: 317 - DNA, 50 bp, Artificial
  Synthetic oligonucleotide
atcccagcaccgactactaccaagagctgcagagagacatttctgaaatg

SEQ ID NO: 318 - DNA, 9 bp, Artificial
  Synthetic oligonucleotide
tttttgcag

SEQ ID NO: 319 - DNA, 47 bp, Artificial
  Synthetic oligonucleotide
atttataaacaagggggttttctgggcctctccaatattaagttcag

SEQ ID NO: 320 - DNA, 5 bp, Artificial
  Synthetic oligonucleotide
gccag

SEQ ID NO: 321 - DNA, 32 bp, Artificial
  Synthetic oligonucleotide
tgagtgatgtgccatttcctttctctgcccag

SEQ ID NO: 322 - DNA, 90 bp, Artificial
  Synthetic oligonucleotide
tctggggctggggtgccaggctggggcatcgcgctgctggtgctggtctgtgttctggttgcgctggccattgtctatctcattgccttg

SEQ ID NO: 323 - DNA, 10 bp, Artificial
  Synthetic oligonucleotide
ctatgagaag

SEQ ID NO: 324 - DNA, 27 bp, Artificial
  Synthetic oligonucleotide
gtagaagaagaagtgtcagcagaccag

SEQ ID NO: 325 - DNA, 32 bp, Artificial
  Synthetic oligonucleotide
gtttctgcaggtaatggtggcagcagcctctc

SEQ ID NO: 326 - DNA, 99 bp, Artificial
  Synthetic oligonucleotide
ttacacaaacccagcagtggcagccacttctgccaacttgtaggggcacgtcgcccgctgagctgagtggccagccagtgccattccactccactcagg

SEQ ID NO: 327 - protein, 322 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGTACRSRIANSCHSGDSWRNSCFANSDSAALAVSSEESGGQRALTAPRG

SEQ ID NO: 328 - protein, 382 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTVIL

SEQ ID NO: 329 - protein, 373 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDREVRGQEDPEGVEDKCVLAQSRGQSKILLGQLSVNTVMV

SEQ ID NO: 330 - protein, 233 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTVSIS

SEQ ID NO: 331 - protein, 112 aa, Homo sapiens
MYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 332 - protein, 222 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGSPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 333 - protein, 93 aa, Homo sapiens
MWVLGIAATFCGLFLLPGFALQIQCYQCEEFQLNNDCSSPEFIVNCTVNVQDMCQKEVMEQSAGSHCVTRLECSGTISAHCNLCLPGSNDHPT

SEQ ID NO: 334 - protein, 84 aa, Homo sapiens
MWVLGIAATFCGLFLLPGFALQIQCYQCEEFQLNNDCSSPEFIVNCTVNVQDMCQKEVMEQSADTKRTNTLLFEMRHFAKQLTT

SEQ ID NO: 335 - protein, 90 aa, Homo sapiens
MWVLGIAATFCGLFLLPGFALQIQCYQCEEFQLNNDCSSPEFIVNCTVNVQDMCQKEVMEQSADRVSLCHEAGVQWNNFSTLQPLPPRLK

SEQ ID NO: 336 - protein, 255 aa, Homo sapiens [sequence omitted]

SEQ ID NO: 337 - protein, 80 aa, Homo sapiens
MRILQLILLALATGLVGGETRIIKGFECKPHSQPWQAALFEKTRLLCGATLIAPRWLLTAAHCLKPTPASHLAMRQHHHH

SEQ ID NO: 338 - protein, 137 aa, Homo sapiens
MAARALCMLGLVLALLSSSSAEEYVGLSQQGLWQLTGLCLGQLQTSVPCQPRTGWTAATPMSPPRSATTGAAALTPGSLECLGVSSPCRKQNAPSEAPPAAPGRGMRGSEHPCPAVIAARHCSSQLFCPFAPGKRFC

SEQ ID NO: 339 - protein, 41 aa, Homo sapiens [sequence omitted]

SEQ ID NO: 340 - protein, 887 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVRPHRSLSIQELGEPGPSEGWGG

SEQ ID NO: 341 - protein, 843 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGDVTLSGPQVTLLPFPCTPAPCSLCS

SEQ ID NO: 342 - protein, 1084 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGSGCKGKQEGGQERTVTGRWTAQEATEGKKGGP

SEQ ID NO: 343 - protein, 1397 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVRAREGVGPGTGGGEGVE

SEQ ID NO: 344 - protein, 1415 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQVNHSLVNHSLAWVARTPGPRGQARSRPQPPTRGIPAALLPGVFGGRLTSWLRDLEL

SEQ ID NO: 345 - protein, 1483 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKAERQGGAVWHGHRGRHPPEWIPRPAC

SEQ ID NO: 346 - protein, 1349 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQVGAVPGLWRGWVVLRPRACLSPGSTSLGHGDCPGCPVCLLDCLPHH

SEQ ID NO: 347 - protein, 1533 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVSGER

SEQ ID NO: 348 - protein, 1670 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFSMKQTGEAGRAGGRQGG

SEQ ID NO: 349 - protein, 1685 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGQSSHRGPGLTLPRGPAVLVSLGVACSSYRSCTQPVCSDTNFLPSQPQSNSPFPLLLTPS

SEQ ID NO: 350 - protein, 1579 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSSADVLCFTGHQVRADSWPPCVLLKSASVLRGSALASVAPWSGVCRTRMATG

SEQ ID NO: 351 - protein, 1657 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGETEGLGRGSGGGMAGAPPTLSDGFPNFREVPSPASRPGAGSAGRGWLQDEVCLLLPPCGVRLPG

SEQ ID NO: 352 - protein, 1691 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGETEGLGRGSGGGMAGAPPTLSDGFPNFREVPSPASRPGAGSAGRGWLQDEVCLLLPPCGVRSVFPPRPWPDPPSGTGCFGLSGCSLLLLQVMHAACLL

SEQ ID NO: 353 - protein, 1253 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSRNPVRLLQPRAQMFCVLRGTK

SEQ ID NO: 354 - protein, 843 aa, Homo sapiens; identical to SEQ ID NO: 341

SEQ ID NO: 355 - protein, 394 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQVSSRGEG

SEQ ID NO: 356 - protein, 263 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYAGEWTEPHFPLKGRVPGRPGEAEYGHY

SEQ ID NO: 357 - protein, 1533 aa, Homo sapiens; identical to SEQ ID NO: 347

SEQ ID NO: 358 - protein, 1555 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWWAPGAALGQGREGRTQAGAGLLEPAQAEPGRQLTRLHRRNGKVGLSGMAIADVTLLSGFHALRADLEKVWSATQGNPLCPRY

SEQ ID NO: 359 - protein, 496 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSPVPRRATDWRGVPSEIDAAFQDADGALGVRQLVGGGHSSRFSHLVVAGLPHACHRKSGSSSQVLCPEPSALLSVAG

SEQ ID NO: 360 - protein, 382 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQELGFPSSTGRDESLEHCRCQGLHK

SEQ ID NO: 361 - protein, 370 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGTTGVSTPAPGV

SEQ ID NO: 362 - protein, 301 aa, Homo sapiens
MAPAAWLRSAAARALLPPMLLLLLQPPPLLARALPPDVHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEVRPCLPVPLLLCWPL

SEQ ID NO: 363 - protein, 354 aa, Homo sapiens [sequence omitted]

SEQ ID NO: 364 - protein, 1645 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFRSQEHAKRKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKGSMKSISEFLVLLSELKWMMLSKFVLKI

SEQ ID NO: 365 - protein, 2074 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFRSQEHAKRKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPVDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEDVPHPWVWKMER

SEQ ID NO: 366 - protein, 603 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSSKSEYYFCSSVFHSCG

SEQ ID NO: 367 - protein, 310 aa, Homo sapiens
MVYKTLFALCILTAGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGIPPMEDFWTTMTTGPGETTTTLCTMTPNNGIWPGMRINCSLFISAYPVELIST

SEQ ID NO: 368 - protein, 584 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPGARLPRHATPCWCPDPPPGPGVPPTGWGPTLPSRAVLARSSAEGGQPRGTVSTAPGMGLGCSPGLCVGVPLPTSFPLALADPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 369 - protein, 490 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKTQNRQGHLWPPRPRPLACRGPWSSASQPALSSSWAPCSCGFARPRRSRAPPRLPLPCLGTARRGRPATAAETRTFPRWPPSALALVWGCVRSMGLRQPPSTYWAQAQLLALSCTPNSTQTSTHTHTHTLTHTHTWRARSTSTSTISARRHRICSGHGGAGQTGRLGGWRTELQTKAGDPWRGGMASTPGSLCVRHSPWTHTHRHTHYLDACMHTHARTRAP

SEQ ID NO: 370 - protein, 203 aa, Homo sapiens
MTPGTQSPFFLLLLLTVLTVVTGSGHASSTPGGEKETSATQRSSVPSSTEKNAIPAPTTTKSCRETFLKCFCRFINKGVFWASPILSSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 371 - protein, 149 aa, Homo sapiens
MTPGTQSPFFLLLLLTVLTVVTGSGHASSTPGGEKETSATQRSSVPSSTEKNAFNSSLEDPSTDYYQELQRDISEMFLQIYKQGGFLGLSNIKFSLGLGCQAGASRCWCWSVFWLRWPLSISLPWLSVSAAERTTGSWTSFQPGIPTIL

SEQ ID NO: 372 - protein, 166 aa, Homo sapiens
MTPGTQSPFFLLLLLTVLTATTAPKPATVVTGSGHASSTPGGEKETSATQRSSVPSSTEKNASGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 373 - protein, 157 aa, Homo sapiens
MTPGTQSPFFLLLLLTVLTVVTGSGHASSTPGGEKETSATQRSSVPSSTEKNASGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 374 - protein, 159 aa, Homo sapiens
MTPGTQSPFFLLLLLTVLTATTAPKPATVVTGSGHASSTPGGEKETSATQRSSVPSSTEKNAFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 375 - protein, 136 aa, Homo sapiens
MTPGTQSPFFLLLLLTVLTATTAPKPATVVTGSGHASSTPGGEKETSATQRSSVPSSTEKNAAVCQCRRKNYGQLDIFPARDTYHPMSEYPTYHTHGRYVPPSSTDRSPYEKVSAGNGGSSLSYTNPAVAATSANL

SEQ ID NO: 376 - protein, 80 aa, Homo sapiens
MTPGTQSPFFLLLLLTVLTATTAPKPATVATGSGHASSTPGGEKETSATQRSSVPSSTEKNAIPAPTTTKSCRETFLKCE

SEQ ID NO: 377 - protein, 126 aa, Homo sapiens [sequence omitted]

SEQ ID NO: 378 - protein, 71 aa, Homo sapiens [sequence omitted]

SEQ ID NO: 379 - protein, 53 aa, Homo sapiens
MTPGTQSPFFLLLLLTVLTVVTGSGHASSTPGGEKETSATQRSSVPSSTEKNA

SEQ ID NO: 380 - protein, 128 aa, Homo sapiens [sequence omitted]

SEQ ID NO: 381 - protein, 158 aa, Homo sapiens [sequence omitted]

SEQ ID NO: 382 - protein, 96 aa, Homo sapiens [sequence omitted]

SEQ ID NO: 383 - protein, 85 aa, Homo sapiens
MTPGTQSPFFLLLLLTVLTVVTGSGHASSTPGGEKETSATQRSSVEEEVSADQVSVGASGVLGSFKEARNAPSFLSWSFSMGPSK

SEQ ID NO: 384 - protein, 882 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 385 - protein, 417 aa, Homo sapiens
MRFAWTVLLLGPLQLCALVHCAPPAAGQQQPPREPPAAPGAWRQQIQWENNGQVFSLLSLGSQYQPQRRRDPGAAVPGAANASAQQPRTPILLIRDNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 386 - protein, 250 aa, Homo sapiens
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 387 - protein, 80 aa, Homo sapiens
MAARALCMLGLVLALLSSSSAEEYVGLSANQCAVPAKDRVDCGYPHVTPKECNNRGCCFDSRIPGVPWCFKPLQEAECTF

SEQ ID NO: 388 - protein, 1744 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALSLTKAPVDLLGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 389 - protein, 1744 aa, Homo sapiens [sequence omitted]

SEQ ID NO: 390 - protein, 1744 aa, Homo sapiens
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 391 - protein, 488 aa, Homo sapiens [sequence omitted]

SEQ ID NO: 392 - protein, 2224 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPVDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSITLRLELFGCDIY

SEQ ID NO: 393 - protein, 2224 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFRSQEHAKRKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPVDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSITLRLELFGCDIY

SEQ ID NO: 394 - protein, 310 aa, Homo sapiens
MVYKTLFALCILTAGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLKEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGSIAAITVTVIAVVLLVFGVAAYLKIRHSSYGRLLDDHDYGSWGNYNNPLYDDS

SEQ ID NO: 395 - protein, 310 aa, Homo sapiens
MVYKTLFALCILTAGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGSIAAITVTVIAVVLLVFGVAAYLKIRHSSYGRLLDDHDYGSWGNYNNPLYDDS

SEQ ID NO: 396 - protein, 244 aa, Homo sapiens
MVYKTLFALCILTAGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETPPPFPG

SEQ ID NO: 397 - protein, 310 aa, Homo sapiens; identical to SEQ ID NO: 395

SEQ ID NO: 398 - protein, 1255 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 399 - DNA, 21 bp, Homo sapiens
tgacactggcaaaacaatgca

SEQ ID NO: 400 - DNA, 21 bp, Homo sapiens
ggtccttttcaccagcaagct

SEQ ID NO: 401 - DNA, 94 bp, Artificial
  Synthetic oligonucleotide
tgacactggcaaaacaatgcagactttgctttccttggtcaggcagtataatccaaagatggtcaaggtcgcaagcttgctggtgaaaaggacc

SEQ ID NO: 402 - DNA, 19 bp, Homo sapiens
tgagagtgattcgcgtggg

SEQ ID NO: 403 - DNA, 21 bp, Homo sapiens
ccagggtacgaggctttcaat

SEQ ID NO: 404 - DNA, 91 bp, Artificial
  Synthetic oligonucleotide
tgagagtgattcgcgtgggtacccgcaagagccagcttgctcgcatacagacggacagtgtggtggcaacattgaaagcctcgtaccctgg

SEQ ID NO: 405 - DNA, 20 bp, Homo sapiens
tgggaacaagagggcatctg

SEQ ID NO: 406 - DNA, 22 bp, Homo sapiens
ccaccactgcatcaaattcatg

SEQ ID NO: 407 - DNA, 86 bp, Artificial
  Synthetic oligonucleotide
tgggaacaagagggcatctgctaaagtttcagattccatttctgctcagtatccagtagtggatcatgaatttgatgcagtggtgg

SEQ ID NO: 408 - DNA, 23 bp, Homo sapiens
tggcaagaagaaggtctggttag

SEQ ID NO: 409 - DNA, 22 bp, Homo sapiens
tgatcagcccatctttgatgag

SEQ ID NO: 410 - DNA, 101 bp, Homo sapiens
tggcaagaagaaggtctggttagaccccaatgagaccaatgaaatcgccaatgccaactcccgtcagcagatccggaagctcatcaaagatgggctgatca

SEQ ID NO: 411 - DNA, 19 bp, Artificial
  Synthetic oligonucleotide
catggaccccaggcaagtc

SEQ ID NO: 412 - DNA, 21 bp, Artificial
  Synthetic oligonucleotide
ctgtttagggtcgaggctgtg

SEQ ID NO: 413 - DNA, 123 bp, Artificial
  Synthetic oligonucleotide
catggaccccaggcaagtccccccacccacgcatttctaatcatctgccctggttttgcctcctgagtctgttaaggctgtgtgcccctcatcgaggcccgtcacagcctcgaccctaaacag

SEQ ID NO: 414 - DNA, 441 bp, Homo sapiens
aggcaagcccactgcccccccctcagcacccccactgaccccgggcaagccccactgccccccccatcccctcactgaccctgggcaagcccactgcccccccatcccctcaccccgggtaagcccactgcccctcccgtcccccaactgactgaccctaggcaagcccactgcccccccatcccctcaccccgggtaagcccactgccccttccaccccccactgaccccgggcaagccgactattcctcatggaccccaggcaaggcccctgcccccaccatggaccccaggcaagtccccccacccacgcatttctaatcatctgccctggttttgcctcctgagtctgttaaggctgtgtgcccctcatcgaggcccgtcacagcctcgaccctaaacaggcctttagtgctcactcagcttcacttgcaactgcag

SEQ ID NO: 415 - DNA, 2199 bp, Homo sapiens
aaaagcctgggcccgtgggggacgcacatggtcctgttcgtactccaggatggcggcgtaaagggcccgctgctcccgttcctccggggtcagggcgacttggctgcaaaacctcctggggagaaaggcacgcggtgggtgccggggccaggccctccccgcagcggccccaggggcgggcaggagtcccacctgttggcggcctcctggagccgcagccggcgctcctccatctttctctggagctgggtgcagagtcaaggggccgagcgtgggatctgagcgggccctcggttcccaaccccgtcccacacccggagaggccgggacgtcccagggacctcctctcggtgaggggctgtccccagggaggcctcctccagtggcgtcagctctctggaaatgtgacaagctgctgtctagaccccaggaagcccagtggtgtctggacaccagaggagtctctctcatcctcccggattgctctgaggccaggagctttgtgactctgccccctgaagcttctggaagatctcgggtggcagaaaaggagagagctttcctccttcatcggagtatacacggcggtgtcggccggcaggctgggggatgggagcagctgcaggcatggttggcttcaggcgtgttttccctgcaagccatgggtaaccaggggtcaagcggtgggccacatcccacagaggagatgcgggcttgggggatgccccaggagagccgcctactgcaggagacccaccaagcttggcggccgtcgactgggccctctccagacactgctgtgctagtttcagcatcttggaggtgtcggggggcacagtttccccagcttctgggggagggacaagaaggctggtcacagtcggctctaccactgttacttactgctgagataaaatgaggcaacggaaaaggcaggcaagcccactgcccccccctcagcacccccactgaccccgggcaagccccactgccccccccatcccctcactgaccctgggcaagcccactgcccccccatcccctcaccccgggtaagcccactgcccctcccgtcccccaactgactgaccctaggcaagcccactgcccccccatcccctcaccccgggtaagcccactgccccttccaccccccactgaccccgggcaagccgactattcctcatggaccccaggcaaggcccctgcccccaccatggaccccaggcaagtccccccacccacgcatttctaatcatctgccctggttttgcctcctgagtctgttaaggctgtgtgcccctcatcgaggcccgtcacagcctcgaccctaaacaggcctttagtgctcactcagcttcacttgcaactgcaggcctctgggaagtggccgttttacagagacaaggacgtgctgaggggatcgcctcacccatctcccaccggctgtgtccccaaagtcctgccttcccgtagcttggcatggagcacctctgcgcgaccatggacctgctcacacagcccttctgcgcgccgtgggagctgcctctctgtgactcgcccctggacccaccgccccagcgcctgacccacctccctgctgcccttcacagaaaacttctcatagactcccattttctcatcccgccccgatttagcccccgactccccccggaaactgcccttacccgtccccaccttgccagacacggtgggccactggagttcctctgtcttctgggactttgctctccccaggggatcctctgccactcctccacccaactcctcaatcttggagcgccagagctcagccgagctcaccggctccctagggagctggggcaactgttagctccccctgacctgtgtgatcctacgtccagtggctgccccgacctctgtgatcccacgtccaggggctcccccgacctctgtgatcccacgtccagtggctcccccgacctctgtgctcccacgtccagtggctcccccgacctctgtgctcccacgtccagtggctcccccgacctctgtgctcccacgtccagtgggtccccctgacctctgtgatcccacgtccagtggctccccctgacctctgtgctctatgtccagtggctccccctgacctctgtgatcctatgtgcagcggctgctggcctctcaaacttaatgtgttcattgcggaacttgcta

SEQ ID NO: 416 - DNA, 21 bp, Homo sapiens
aaagcatccgattaccccact

SEQ ID NO: 417 - DNA, 20 bp, Homo sapiens
ccggcacaaagttgcagtta

SEQ ID NO: 418 - DNA, 156 bp, Artificial
  Synthetic oligonucleotide
aaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagca

SEQ ID NO: 419 - DNA, 21 bp, Homo sapiens
ctgcaggctcagcaacttctt

SEQ ID NO: 420 - DNA, 21 bp, Homo sapiens
tttcaaatccctcccttgtca

SEQ ID NO: 421 - DNA, 131 bp, Artificial
  Synthetic oligonucleotide
ctgcaggctcagcaacttcttttaatgaaaaacaaactcaccctcttccccagcattctttccatgtgtcagagaagcagaggtttcttgaacgggcttaggagagtctatgacaagggagggatttgaaa

SEQ ID NO: 422 - DNA, 822 bp, Artificial
  Synthetic oligonucleotide
gtgaggcttcttctctgagccctgctccgtgggatcatctgctagacaggtgacctgccaggagggctacaggaaatcctgtctgtaaactaacgcagcagttctcagattttaggcagcatgagcatcacctggagggcttgtgaaagctcaccctgctgcaccccagccccagagtctgggattctgtaaaactgcaactctaacaagtaccaggtgatgctgatgccggtggtctgggaagcacactttgaaaactactcaaggaaacaagaaatggttttcctttagcagtcagcctgttcaagccttagatactccttaggctcttaagaaaagagcttatttcaaatgcattcccccaattttaatcttgtttgaaatggatactttctatgggcagaatcagtaccactttgctattggattcctcatggggatgcagctggtctcacataaaaggttaaaatagcagttagttgttgctgttacagcttcatctgtgccttaacttctagatctttgcaacggtggctttgaactcccacatttaactctttgacactggaaagtgtcattatatcctctaggcttaggatcagattccatttcctgtgtacccaagtaggctgataactgaattctttgtaaaatactcaagacttggcagaagtcacaattaagattttgaagttgtttggcgattaatgttgctgtgttattttgacatagtgatcttaagacagctctttgaagcttttagaacatctattgtatgcttttcctagcatacagacagtctcccccaaccccatccccacc

SEQ ID NO: 423 - DNA, 1306 bp, Artificial
  Synthetic oligonucleotide
caccaaaagaaataaggcacgatatcgttccatggcacgttatccctggcttttgttaccagtaaaatgaatgactttgctgagacaatacttagtgtagcaggtacaagttataaaagtgattcattacaactaagataaggaagaaaacaggaaaacagcacttgcccttcacacacacagaaacacacatgcacacacacacaaacacacccttgtcacagctcagaataaccaattccatccagggatcatattagcgatattggcactgtaatggtcgtttttacatttattttctgttccgcattcacttaacatgtgcgttaaaaggaacaaagctagctggaggtagcaaagttttgaacttgaatcagggattgctaagaaaacttacaactaatgaccacagaaagtaagttctttgtcttctgtctgatacagctagatgtgattgtagccgtggtgcctgggcagatggtaaacaaacatgctgtcctcttatgacaatatgtgcagagaaggccccaaacgctggggtgagaggaacaacaaactgactaactcacggccgagttggagccagaaccaacaacagctcggctgccttcacactcatctgtcaaacacatggtgtatggctcccctgacagaaatgactcctataagcttcctcatactcgcgcattcttggaagtctgagactggaaatgcctacccagatatgttaagtcagtaaaggaaaactcatttgcaatgctgagaggagaaagaaaatcaatgaataggagagcatacactgtgggaaggctcagctgtactgagccaggcaaagcatccgattaccccactgctgtacacatcatgacctgggataaacccctgggccgttggcctaagaaatatgttgcttttcatcctgtataactgcaactttgtgccggctcatattatgttctagagagctcatgtacaccatggtgaccatagttaataatactggattgtatgcttaaaatttgctaagagagtagatcttaagtcatcaccaaaaaaagtaactgtaagatgatggagatgtgttaattagcttgacggtggtaatcacaatatatgtgtatatcaaaacatcacattatacaccttaaatgtatataatatttgtcaattatacctcagtaaagccaaaaagaaataaatatattgcttttcaccctctggcaagtggagggccctgaacagagccctctaaagaacagcttgtcctaatcatcacgtacctgatgaacctctgtttcccctgcag

SEQ ID NO: 424 - DNA, 380 bp, Artificial
  Synthetic oligonucleotide
gtaagcatcttagcctctcagggacgtggagaactgacctgtccttgttgtcgtcaccaagggcagctccacagcatgtatattaagaacacgggttctaggatctctggatcccaatcccactgcttagctgtgcacccttgaacacaacttaccctctctgaggctctttcctcatttgcaacttggagataataatagttcttgataagtttatcttgagcattttatttagatactgcatgtaaagcagttagcactgagttttggtttatggtaagcaccctgtaaatgttaggatattaacagcaacccataaaaacagcgaacttatccgttctctggtagaaaacattccatgttgacatttgggcatgtgg

SEQ ID NO: 425 - DNA, 307 bp, Artificial
  Synthetic oligonucleotide
gtaagtgtgaggtccgctgcaagggtgagcatgggcagcagctctgcccagctggttgcctggcatctgcagcctgcagttcagtgggtcatagagcaggaaggttacctactagagaaacaaacagaagcaaagtcctgcaggctcagcaacttcttttaatgaaaaacaaactcaccctcttccccagcattctttccatgtgtcagagaagcagaggtttcttgaacgggcttaggagagtctatgacaagggagggatttgaaagttgatcttaattgttgcctgtggttcatcttcttacag

SEQ ID NO: 426 - DNA, 259 bp, Artificial
  Synthetic oligonucleotide
gtgagccacgcagcccaggatgaaacgacccaggagctttgctcttttactgaatgctgcagtcagcattcgaggagattccagcttggttagtcctgagcgatttgattgctctaagatgcaggtggacaacataatcccaacaagttatcggttccctataccctataatatcttacactgtgttaagtgcccagcatggcagtatggcagcttagaccaaccatttactgtgactgtctctctctccttgtctcag

SEQ ID NO: 427 - DNA, 450 bp, Artificial
  Synthetic oligonucleotide
gtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcag

SEQ ID NO: 428 - DNA, 310 bp, Artificial
  Synthetic oligonucleotide
tagctctttttgggcaactgtgttccatagtcaactcttctgtccaaaaaaaagttcagtactctatccaaataccagcaaagcatgacttgtgttcacaacatctataaagcctagagcatttacacaaattctgtatgtatatcccccaagaaaagttttattttcttgtcttcccataaaaaaaatatgctgttactgagccaaattctgttctttttctatttggaattccaggtacactccctcgtgcatgagctcagcatgaggaaggcaactgaagcagtgatatatatcttctctttcctag

SEQ ID NO: 429 - DNA, 567 bp, Artificial
  Synthetic oligonucleotide
gtaaaaacagttttctatccctttttcatcttttcagttcagcaacagcctgaaacactttgggattcaaggaaattacatggctatagcaaaaaatataccaaatcaatacacaggataattagaaattattcattgtgttccagtagtttaaggatgtagatgttgccaagagaatttttaaatgagggttttgtttttcatcagaactgtttttctctgtacttgagaaattataatgcataaacaaatgccactttgttccctagattcatttcaaatgtcacatcgaaattacagtaaaattgactttgggcacactatgaactgagatgatgggattatattctacatctcactaacttctaacccacagggatccatttttttaactatgtccttttaacttttgtagtgatcgttttacactgagtgatcaattagcctatccactaggtagaaagtattgctgattttcacagttttagacatattatgcacatggtttgaggcttgagctgttttcaaggacaacattgttaagtgctccatttcttctctttgcag

SEQ ID NO: 430 - DNA, 154 bp, Artificial
  Synthetic oligonucleotide
gtaaggtgctgcctgatcagagggcccgcgggagacagggacatgcacagctttccaaacgtacttctgtctagtcctggctattagtatgcactttggtggaaacatccaaggctggagagcccagctcttatttgtcccttgttctcttcag

SEQ ID NO: 431 - DNA, 825 bp, Artificial
  Synthetic oligonucleotide
gtaggtggatggactcctttcagagtctttcagtaaactgttggaatatccctttcatggcctttgaaaaatgagcttaacaaagttcaaacactttcattactgtggctccctggcttctcatagccaactggaatacgttcatgtaaataatttgcctgatgtgagctccttgcacagagtctcacagatctttagcatgaagatctggtaacttcagtcttaccttctgtaagaagggctactggacttgctcagcatcgtctaccattgttaagacaaattatacaaagcagacatctgtgactgacaactgtacaataatattaatcatatgtaatactaagagatggaaaaataaatgtgcataagcaaaataaccattttcatggctaatgatgtaatctagctataagaaaatcatcaaactaaggatacatccaaaaccaaagtaatttatccctgtcataaacattacccagacagtatacaacacagggaccagtggtctgtttccatcttttcaggacttttcagagaagtcgacgtgtcaacagttttacaactgaaaccttctaaggaaattctctgttataaagtatccagaaaatttcatttaacattaagatgtaaacagttaacatttcatttcatctttagtaattaaatatcactctatttgaccttatttagaaagttttatatgtaaaacatttttaaattatcccttctcagatttttatacgaaaacaaagataaaggaaaaaaacttttaaaatgtaattgctactattgctatctttctgcaggagtgtgtaaatagac

SEQ ID NO: 432 - DNA, 169 bp, Artificial
  Synthetic oligonucleotide
gtgagtagcgagttcttagatcctaagagactgatgcatacatggggaaaaacaaatataaaacctggcagttgtacctatccctgtgggtgctgaggatgtctaggaacatgatggagaaccttctgaaggctgcaggttttaacctggctctgggctcttcttccag

SEQ ID NO: 433 - DNA, 430 bp, Artificial
  Synthetic oligonucleotide
gtaagaagcaaagccctggaacagagagagagcttatgggtgcctgactagcactggggatgctgtgctttgaccaagactctgaccagggagtcttagaaagttcccagcatcaccagctgcagcattgaactctgctttgtaaaaacataatagtgttgaaaagggagcttgaccaagaattgccctgcaaatcctaaggtgccttcagccttttcaaacaaaaaaacctccttccctcctctctgtctgctttatatgtgtgctcagtggcacacaacaaatatgagaggacttggaaaaattccccattgcagccctctaacttagatcagctcagtacctttcaagcattgtttctgatggaatgaaatagaaatctttacctgaaggagctgtgtttcaacctttccttttccttttccttcag

SEQ ID NO: 434 - DNA, 104 bp, Artificial
  Synthetic oligonucleotide
gtacgatcatactgattcactttcacttacagtcacactgagggacaaaaagacaaaaagtattaaatagcattgtcactaaacaagattttttttccctgcag

SEQ ID NO: 435 - DNA, 6391 bp, Artificial
  Synthetic oligonucleotide
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 436 - DNA, 6508 bp, Artificial
  Synthetic oligonucleotide
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggtaaaaacagttttctatccctttttcatcttttcagttcagcaacagcctgaaacactttgggattcaaggaaattacatggctatagcaaaaaatataccaaatcaatacacaggataattagaaattattcattgtgttccagtagtttaaggatgtagatgttgccaagagaatttttaaatgagggttttgtttttcatcagaactgtttttctctgtacttgagaaattataatgcataaacaaatgccactttgttccctagattcatttcaaatgtcacatcgaaattacagtaaaattgactttgggcacactatgaactgagatgatgggattatattctacatctcactaacttctaacccacagggatccatttttttaactatgtccttttaacttttgtagtgatcgttttacactgagtgatcaattagcctatccactaggtagaaagtattgctgattttcacagttttagacatattatgcacatggtttgaggcttgagctgttttcaaggacaacattgttaagtgctccatttcttctctttgcaggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 437 - DNA, 6650 bp, Artificial
  Synthetic oligonucleotide
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattggtgagccacgcagcccaggatgaaacgacccaggagctttgctcttttactgaatgctgcagtcagcattcgaggagattccagcttggttagtcctgagcgatttgattgctctaagatgcaggtggacaacataatcccaacaagttatcggttccctataccctataatatcttacactgtgttaagtgcccagcatggcagtatggcagcttagaccaaccatttactgtgactgtctctctctccttgtctcagatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 438 - DNA, 6095 bp, Artificial
  Synthetic oligonucleotide
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtaaggtgctgcctgatcagagggcccgcgggagacagggacatgcacagctttccaaacgtacttctgtctagtcctggctattagtatgcactttggtggaaacatccaaggctggagagcccagctcttatttgtcccttgttctcttcaggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 439 - DNA, 6200 bp, Artificial
  Synthetic oligonucleotide
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattggtgagccacgcagcccaggatgaaacgacccaggagctttgctcttttactgaatgctgcagtcagcattcgaggagattccagcttggttagtcctgagcgatttgattgctctaagatgcaggtggacaacataatcccaacaagttatcggttccctataccctataatatcttacactgtgttaagtgcccagcatggcagtatggcagcttagaccaaccatttactgtgactgtctctctctccttgtctcagatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 440 - DNA, 6662 bp, Artificial
  Synthetic oligonucleotide
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggtaaaaacagttttctatccctttttcatcttttcagttcagcaacagcctgaaacactttgggattcaaggaaattacatggctatagcaaaaaatataccaaatcaatacacaggataattagaaattattcattgtgttccagtagtttaaggatgtagatgttgccaagagaatttttaaatgagggttttgtttttcatcagaactgtttttctctgtacttgagaaattataatgcataaacaaatgccactttgttccctagattcatttcaaatgtcacatcgaaattacagtaaaattgactttgggcacactatgaactgagatgatgggattatattctacatctcactaacttctaacccacagggatccatttttttaactatgtccttttaacttttgtagtgatcgttttacactgagtgatcaattagcctatccactaggtagaaagtattgctgattttcacagttttagacatattatgcacatggtttgaggcttgagctgttttcaaggacaacattgttaagtgctccatttcttctctttgcaggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtaaggtgctgcctgatcagagggcccgcgggagacagggacatgcacagctttccaaacgtacttctgtctagtcctggctattagtatgcactttggtggaaacatccaaggctggagagcccagctcttatttgtcccttgttctcttcaggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 441 - DNA, 6248 bp, Artificial
  Synthetic oligonucleotide
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccagtaagtgtgaggtccgctgcaagggtgagcatgggcagcagctctgcccagctggttgcctggcatctgcagcctgcagttcagtgggtcatagagcaggaaggttacctactagagaaacaaacagaagcaaagtcctgcaggctcagcaacttcttttaatgaaaaacaaactcaccctcttccccagcattctttccatgtgtcagagaagcagaggtttcttgaacgggcttaggagagtctatgacaagggagggatttgaaagttgatcttaattgttgcctgtggttcatcttcttacagtcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 442 - DNA, 6957 bp, Artificial
  Synthetic oligonucleotide
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccagtaagtgtgaggtccgctgcaagggtgagcatgggcagcagctctgcccagctggttgcctggcatctgcagcctgcagttcagtgggtcatagagcaggaaggttacctactagagaaacaaacagaagcaaagtcctgcaggctcagcaacttcttttaatgaaaaacaaactcaccctcttccccagcattctttccatgtgtcagagaagcagaggtttcttgaacgggcttaggagagtctatgacaagggagggatttgaaagttgatcttaattgttgcctgtggttcatcttcttacagtcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattggtgagccacgcagcccaggatgaaacgacccaggagctttgctcttttactgaatgctgcagtcagcattcgaggagattccagcttggttagtcctgagcgatttgattgctctaagatgcaggtggacaacataatcccaacaagttatcggttccctataccctataatatcttacactgtgttaagtgcccagcatggcagtatggcagcttagaccaaccatttactgtgactgtctctctctccttgtctcagatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 443 - DNA, 6110 bp, Artificial
  Synthetic oligonucleotide
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggtgagtagcgagttcttagatcctaagagactgatgcatacatggggaaaaacaaatataaaacctggcagttgtacctatccctgtgggtgctgaggatgtctaggaacatgatggagaaccttctgaaggctgcaggttttaacctggctctgggctcttcttccaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 444 - DNA, 6371 bp, Artificial
  Synthetic oligonucleotide
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtaagaagcaaagccctggaacagagagagagcttatgggtgcctgactagcactggggatgctgtgctttgaccaagactctgaccagggagtcttagaaagttcccagcatcaccagctgcagcattgaactctgctttgtaaaaacataatagtgttgaaaagggagcttgaccaagaattgccctgcaaatcctaaggtgccttcagccttttcaaacaaaaaaacctccttccctcctctctgtctgctttatatgtgtgctcagtggcacacaacaaatatgagaggacttggaaaaattccccattgcagccctctaacttagatcagctcagtacctttcaagcattgtttctgatggaatgaaatagaaatctttacctgaaggagctgtgtttcaacctttccttttccttttccttcaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 445 - DNA, 6540 bp, Artificial
  Synthetic oligonucleotide
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggtgagtagcgagttcttagatcctaagagactgatgcatacatggggaaaaacaaatataaaacctggcagttgtacctatccctgtgggtgctgaggatgtctaggaacatgatggagaaccttctgaaggctgcaggttttaacctggctctgggctcttcttccaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtaagaagcaaagccctggaacagagagagagcttatgggtgcctgactagcactggggatgctgtgctttgaccaagactctgaccagggagtcttagaaagttcccagcatcaccagctgcagcattgaactctgctttgtaaaaacataatagtgttgaaaagggagcttgaccaagaattgccctgcaaatcctaaggtgccttcagccttttcaaacaaaaaaacctccttccctcctctctgtctgctttatatgtgtgctcagtggcacacaacaaatatgagaggacttggaaaaattccccattgcagccctctaacttagatcagctcagtacctttcaagcattgtttctgatggaatgaaatagaaatctttacctgaaggagctgtgtttcaacctttccttttccttttccttcaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 446 - DNA, 5789 bp, Artificial
  Synthetic oligonucleotide
caccaaaagaaataaggcacgatatcgttccatggcacgttatccctggcttttgttaccagtaaaatgaatgactttgctgagacaatacttagtgtagcaggtacaagttataaaagtgattcattacaactaagataaggaagaaaacaggaaaacagcacttgcccttcacacacacagaaacacacatgcacacacacacaaacacacccttgtcacagctcagaataaccaattccatccagggatcatattagcgatattggcactgtaatggtcgtttttacatttattttctgttccgcattcacttaacatgtgcgttaaaaggaacaaagctagctggaggtagcaaagttttgaacttgaatcagggattgctaagaaaacttacaactaatgaccacagaaagtaagttctttgtcttctgtctgatacagctagatgtgattgtagccgtggtgcctgggcagatggtaaacaaacatgctgtcctcttatgacaatatgtgcagagaaggccccaaacgctggggtgagaggaacaacaaactgactaactcacggccgagttggagccagaaccaacaacagctcggctgccttcacactcatctgtcaaacacatggtgtatggctcccctgacagaaatgactcctataagcttcctcatactcgcgcattcttggaagtctgagactggaaatgcctacccagatatgttaagtcagtaaaggaaaactcatttgcaatgctgagaggagaaagaaaatcaatgaataggagagcatacactgtgggaaggctcagctgtactgagccaggcaaagcatccgattaccccactgctgtacacatcatgacctgggataaacccctgggccgttggcctaagaaatatgttgcttttcatcctgtataactgcaactttgtgccggctcatattatgttctagagagctcatgtacaccatggtgaccatagttaataatactggattgtatgcttaaaatttgctaagagagtagatcttaagtcatcaccaaaaaaagtaactgtaagatgatggagatgtgttaattagcttgacggtggtaatcacaatatatgtgtatatcaaaacatcacattatacaccttaaatgtatataatatttgtcaattatacctcagtaaagccaaaaagaaataaatatattgcttttcaccctctggcaagtggagggccctgaacagagccctctaaagaacagcttgtcctaatcatcacgtacctgatgaacctctgtttcccctgcagccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 447 - DNA, 4335 bp, Artificial
  Synthetic oligonucleotide
tagctctttttgggcaactgtgttccatagtcaactcttctgtccaaaaaaaagttcagtactctatccaaataccagcaaagcatgacttgtgttcacaacatctataaagcctagagcatttacacaaattctgtatgtatatcccccaagaaaagttttattttcttgtcttcccataaaaaaaatatgctgttactgagccaaattctgttctttttctatttggaattccaggtacactccctcgtgcatgagctcagcatgaggaaggcaactgaagcagtgatatatatcttctctttcctaggataattgccccaaccttcccaactcagggcaggaagactatgacaaggatggaattggtgatgcctgtgatgatgacgatgacaatgataaaattccagatgacagggtaaaaacagttttctatccctttttcatcttttcagttcagcaacagcctgaaacactttgggattcaaggaaattacatggctatagcaaaaaatataccaaatcaatacacaggataattagaaattattcattgtgttccagtagtttaaggatgtagatgttgccaagagaatttttaaatgagggttttgtttttcatcagaactgtttttctctgtacttgagaaattataatgcataaacaaatgccactttgttccctagattcatttcaaatgtcacatcgaaattacagtaaaattgactttgggcacactatgaactgagatgatgggattatattctacatctcactaacttctaacccacagggatccatttttttaactatgtccttttaacttttgtagtgatcgttttacactgagtgatcaattagcctatccactaggtagaaagtattgctgattttcacagttttagacatattatgcacatggtttgaggcttgagctgttttcaaggacaacattgttaagtgctccatttcttctctttgcaggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaattta

SEQ ID NO: 448 - DNA, 3695 bp, Artificial
  Synthetic oligonucleotide
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcaggtaggtggatggactcctttcagagtctttcagtaaactgttggaatatccctttcatggcctttgaaaaatgagcttaacaaagttcaaacactttcattactgtggctccctggcttctcatagccaactggaatacgttcatgtaaataatttgcctgatgtgagctccttgcacagagtctcacagatctttagcatgaagatctggtaacttcagtcttaccttctgtaagaagggctactggacttgctcagcatcgtctaccattgttaagacaaattatacaaagcagacatctgtgactgacaactgtacaataatattaatcatatgtaatactaagagatggaaaaataaatgtgcataagcaaaataaccattttcatggctaatgatgtaatctagctataagaaaatcatcaaactaaggatacatccaaaaccaaagtaatttatccctgtcataaacattacccagacagtatacaacacagggaccagtggtctgtttccatcttttcaggacttttcagagaagtcgacgtgtcaacagttttacaactgaaaccttctaaggaaattctctgttataaagtatccagaaaatttcatttaacattaagatgtaaacagttaacatttcatttcatctttagtaattaaatatcactctatttgaccttatttagaaagttttatatgtaaaacatttttaaattatcccttctcagatttttatacgaaaacaaagataaaggaaaaaaacttttaaaatgtaattgctactattgctatctttctgcaggagtgtgtaaatagac

SEQ ID NO: 449 - DNA, 2012 bp, Artificial
  Synthetic oligonucleotide
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatgtaagcatcttagcctctcagggacgtggagaactgacctgtccttgttgtcgtcaccaagggcagctccacagcatgtatattaagaacacgggttctaggatctctggatcccaatcccactgcttagctgtgcacccttgaacacaacttaccctctctgaggctctttcctcatttgcaacttggagataataatagttcttgataagtttatcttgagcattttatttagatactgcatgtaaagcagttagcactgagttttggtttatggtaagcaccctgtaaatgttaggatattaacagcaacccataaaaacagcgaacttatccgttctctggtagaaaacattccatgttgacatttgggcatgtgg

SEQ ID NO: 450 - DNA, 1787 bp, Artificial
  Synthetic oligonucleotide
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccaggtgaggcttcttctctgagccctgctccgtgggatcatctgctagacaggtgacctgccaggagggctacaggaaatcctgtctgtaaactaacgcagcagttctcagattttaggcagcatgagcatcacctggagggcttgtgaaagctcaccctgctgcaccccagccccagagtctgggattctgtaaaactgcaactctaacaagtaccaggtgatgctgatgccggtggtctgggaagcacactttgaaaactactcaaggaaacaagaaatggttttcctttagcagtcagcctgttcaagccttagatactccttaggctcttaagaaaagagcttatttcaaatgcattcccccaattttaatcttgtttgaaatggatactttctatgggcagaatcagtaccactttgctattggattcctcatggggatgcagctggtctcacataaaaggttaaaatagcagttagttgttgctgttacagcttcatctgtgccttaacttctagatctttgcaacggtggctttgaactcccacatttaactctttgacactggaaagtgtcattatatcctctaggcttaggatcagattccatttcctgtgtacccaagtaggctgataactgaattctttgtaaaatactcaagacttggcagaagtcacaattaagattttgaagttgtttggcgattaatgttgctgtgttattttgacatagtgatcttaagacagctctttgaagcttttagaacatctattgtatgcttttcctagcatacagacagtctcccccaaccccatccccacc

SEQ ID NO: 451 - DNA, 8216 bp, Artificial
  Synthetic oligonucleotide
tttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccagtaagtgtgaggtccgctgcaagggtgagcatgggcagcagctctgcccagctggttgcctggcatctgcagcctgcagttcagtgggtcatagagcaggaaggttacctactagagaaacaaacagaagcaaagtcctgcaggctcagcaacttcttttaatgaaaaacaaactcaccctcttccccagcattctttccatgtgtcagagaagcagaggtttcttgaacgggcttaggagagtctatgacaagggagggatttgaaagttgatcttaattgttgcctgtggttcatcttcttacagtcaatggaggctggggtccttggtcaccatgggacatctgttctgtcacctgtggaggaggggtacagaaacgtagtcgtctctgcaacaaccccacaccccagtttggaggcaaggactgcgttggtgatgtaacagaaaaccagatctgcaacaagcaggactgtccaattggtgagccacgcagcccaggatgaaacgacccaggagctttgctcttttactgaatgctgcagtcagcattcgaggagattccagcttggttagtcctgagcgatttgattgctctaagatgcaggtggacaacataatcccaacaagttatcggttccctataccctataatatcttacactgtgttaagtgcccagcatggcagtatggcagcttagaccaaccatttactgtgactgtctctctctccttgtctcagatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatatttatacttactgtatccatgcttatttgttctctactggctttatgtcatgaagtatatgcgtaaataccattcataaatcaatatagcatatacaaaaataaattacagtaagtcatagcaacattcacagtttgtatgtgattgagaaagactgagttgctcaggcctaggcttagaatttgctgcgtttgtggaataaaagaacaaaatgatacattagcctgccatatcaaaaacatataaaagagaaattatccctaagtcaagggcccccataagaataaaatttcttattaaggtcattagatgtcattgaatccttttcaaagtgcagtatgaaaacaaagggaaaaacactgaagcacacgcaactctcacagcgacattttctgacccacgaatgatgccttgggtgggcaacacgattgcatgttgtggagacacttcggaagtaaatgtggatgagggaggagctgtccttgcaatgttgagccaagcattacagatacctcctcttgaagaaggaataataagtttaatcaaaaaagaagactaaaaaatgtaaaatttggaaggaatccataaatgcgtgtgtgtctaaatacaaattatcatgtgaagaaaaggcccaagtgtaccaataagcagaccttgatttttggatgggctaattatgaatgtggaatactgaccagttaatttccagttttaatgaaaacagatcaaagaagaaattttatgagtaggttaaaggtctggctttgaggtctattaaacactagaaaggactggctgggtgagataaaatcttccttgttgattttcactctcattctataaatactcatctttctgagtagccatgatcacatacaaatgtaaattgccaaatcattttatagtaccaaggtgaagaagcaggaactagaaagtgttgataatagctgtggagttaggaaaactgatgtgaaggaaataattctttgaaatggcaaagaattaaataccatcattcattatcagaagagttcaacgtttgaagtgctgggagataattctaattcattcttggatagtgaagcaaaactgattgaaaataccaagataagacagaaaaagtgactggaaagaggagcttttcttccaggcatgttccagtttcaccctaagactgaccttcaaataatcaggttgtactgaaataaaggacttgttaaaaattaaaattatgtcatcgagatgatagcttttttcctcctccaacagtttattgtcatgtgttgtgggagagctcgagtgaagagcaataaactccaggtcttataagaatgtacatacaataaaggtggtgccagcagtttttttttttctaaagagtcacatgtagaaaagcctccagtattaagctcctgaattcattccttaaataaattggctctctctctcttctataatttctttttctttttatttttgagatgaagtcttgctctgtcgcccaggctggagtgcagtgacacaatctcggctcactgcaacctctgcctccccggttcaagcaattctccctcctgcctcagcctcccaagtagctgggactacaagcgcccgccaccaagcctggctaattctgtatttttagtaaagacggggtttcaccttgttccggacaaacactaagccctaaagggaaatccaaaataa

SEQ ID NO: 452 - protein, 685 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVQSTRRVNQRTGELSLTKITGSGRNVISYPSPKKKGRGDECTV

SEQ ID NO: 453 - protein, 804 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRVKTVFYPFFIFSVQQQPETLWDSRKLHGYSKKYTKSIHRIIRNYSLCSSSLRM

SEQ ID NO: 454 - protein, 555 aa, Homo sapiens [sequence omitted]

SEQ ID NO: 455 - protein, 828 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGKVLPDQRARGRQGHAQLSKRTSV

SEQ ID NO: 456 - protein, 578 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPSKCEVRCKGEHGQQLCPAGCLASAACSSVGHRAGRLPTRETNRSKVLQAQQLLLMKNKLTLFPSILSMCQRSRGFLNGLRRVYDKGGI

SEQ ID NO: 457 - protein, 1000 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGE

SEQ ID NO: 458 - protein, 1105 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRSKALEQRESLWVPD

SEQ ID NO: 459 - protein, 702 aa, Homo sapiens [sequence omitted]

SEQ ID NO: 460 - protein, 345 aa, Homo sapiens [sequence omitted]

SEQ ID NO: 461 - protein, 855 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQVGGWTPFRVFQ

SEQ ID NO: 462 - protein, 459 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRCKHLSLSGTWRTDLSLLSSPRAAPQHVY

SEQ ID NO: 463 - protein, 214 aa, Homo sapiens [sequence omitted]

SEQ ID NO: 464 - protein, 42 aa, Homo sapiens
QSTRRVNQRTGELSLTKITGSGRNVISYPSPKKKGRGDECTV

SEQ ID NO: 465 - protein, 53 aa, Homo sapiens
VKTVFYPFFIFSVQQQPETLWDSRKLHGYSKKYTKSIHRIIRNYSLCSSSLRM

SEQ ID NO: 466 - protein, 7 aa, Homo sapiens
GEPRSPG

SEQ ID NO: 467 - protein, 23 aa, Homo sapiens
KVLPDQRARGRQGHAQLSKRTSV

SEQ ID NO: 468 - protein, 88 aa, Homo sapiens
SKCEVRCKGEHGQQLCPAGCLASAACSSVGHRAGRLPTRETNRSKVLQAQQLLLMKNKLTLFPSILSMCQRSRGFLNGLRRVYDKGGI

SEQ ID NO: 469 - protein, 14 aa, Homo sapiens
SKALEQRESLWVPD

SEQ ID NO: 470 - protein, 11 aa, Homo sapiens
VGGWTPFRVFQ

SEQ ID NO: 471 - protein, 28 aa, Homo sapiens
CKHLSLSGTWRTDLSLLSSPRAAPQHVY

SEQ ID NO: 472 - protein, 5 aa, Homo sapiens
VRLLL

SEQ ID NO: 473 - DNA, 26 bp, Artificial
  Synthetic oligonucleotide
aaggacctgatgatacagaggaatta

SEQ ID NO: 474 - DNA, 19 bp, Artificial
  Synthetic oligonucleotide
tcagaaagtgccgtcgatg

SEQ ID NO: 475 - DNA, 139 bp, Artificial
  Synthetic oligonucleotide
aaggacctgatgatacagaggaattacaacacatatacttagtgtttcaatgaacaccaagataaataagtgaagagctagtccgctgtgagtctcctcagtgacacagggctggatcaccatcgacggcactttctga

SEQ ID NO: 476 - DNA, 7135 bp, Homo sapiens
gaaatctgagaaatggtatggttgtatgtgggttggcattcttgcatgatgggagtggccacctgctttcatattctgaagtcagagtgttccagacagaagaaatagcaagtgccgagaagctggcatcagaaaaacagaggggagatttgtgtggctgcagccgagggagaccaggaagatctgcatggtgggaaggacctgatgatacagaggaattacaacacatatacttagtgtttcaatgaacaccaagataaataagtgaagagctagtccgctgtgagtctcctcagtgacacagggctggatcaccatcgacggcactttctgagtactcagtgcagcaaagaaagactacagacatctcaatggcaggggtgagaaataagaaaggctgctgactttaccatctgaggccacacatctgctgaaatggagataattaacatcactagaaacagcaagatgacaatataatgtctaagtagtgacatgtttttgcacatttccagcccctttaaatatccacacacacaggaagcacaaaaggaagcacagagatccctgggagaaatgcccggccgccatcttgggtcatcgatgagcctcgccctgtgcctggtcccgcttgtgagggaaggacattagaaaatgaattgatgtgttccttaaaggatgggcaggaaaacagatcctgttgtggatatttatttgaacgggattacagatttgaaatgaagtcacaaagtgagcattaccaatgagaggaaaacagacgagaaaatcttgatggcttcacaagacatgcaacaaacaaaatggaatactgtgatgacatgaggcagccaagctggggaggagataaccacggggcagagggtcaggattctggccctgctgcctaaactgtgcgttcataaccaaatcatttcatatttctaaccctcaaaacaaagctgttgtaatatctgatctctacggttccttctgggcccaacattctccatatatccagccacactcatttttaatatttagttcccagatctgtactgtgacctttctacactgtagaataacattactcattttgttcaaagacccttcgtgttgctgcctaatatgtagctgactgtttttcctaaggagtgttctggcccaggggatctgtgaacaggctgggaagcatctcaagatctttccagggttatacttactagcacacagcatgatcattacggagtgaattatctaatcaacatcatcctcagtgtctttgcccatactgaaattcatttcccacttttgtgcccattctcaagacctcaaaatgtcattccattaatatcacaggattaacttttttttttaacctggaagaattcaatgttacatgcagctatgggaatttaattacatattttgttttccagtgcaaagatgactaagtcctttatccctcccctttgtttgattttttttccagtataaagttaaaatgcttagccttgtactgaggctgtatacagccacagcctctccccatccctccagccttatctgtcatcaccatcaacccctcccatgcacctaaacaaaatctaacttgtaattccttgaacatgtcaggcatacattattccttctgcctgagaagctcttccttgtctcttaaatctagaatgatgtaaagttttgaataagttgactatcttacttcatgcaaagaagggacacatatgagattcatcatcacatgagacagcaaatactaaaagtgtaatttgattataagagtttagataaatatatgaaatgcaagagccacagagggaatgtttatggggcacgtttgtaagcctgggatgtgaagcaaaggcagggaacctcatagtatcttatataatatacttcatttctctatctctatcacaatatccaacaagcttttcacagaattcatgcagtgcaaatccccaaaggtaacctttatccatttcatggtgagtgcgctttagaattttggcaaatcatactggtcacttatctcaactttgagatgtgtttgtccttgtagttaattgaaagaaatagggcactcttgtgagccactttagggttcactcctggcaataaagaatttacaaagagctactcaggaccagttgttaagagctctgtgtgtgtgtgtgtgtgtgtgagtgtacatgccaaagtgtgcctctctctcttgacccattatttcagacttaaaacaagcatgttttcaaatggcactatgagctgccaatgatgtatcaccaccatatctcattattctccagtaaatgtgataataatgtcatctgttaacataaaaaaagtttgacttcacaaaagcagctggaaatggacaaccacaatatgcataaatctaactcctaccatcagctacacactgcttgacatatattgttagaagcacctcgcatttgtgggttctcttaagcaaaatacttgcattaggtctcagctggggctgtgcatcaggcggtttgagaaatattcaattctcagcagaagccagaatttgaattccctcatcttttaggaatcatttaccaggtttggagaggattcagacagctcaggtgctttcactaatgtctctgaacttctgtccctctttgtgttcatggatagtccaataaataatgttatctttgaactgatgctcataggagagaatataagaactctgagtgatatcaacattagggattcaaagaaatattagatttaagctcacactggtcaaaaggaaccaagatacaaagaactctgagctgtcatcgtccccatctctgtgagccacaaccaacagcaggacccaacgcatgtctgagatccttaaatcaaggaaaccagtgtcatgagttgaattctcctattatggatgctagcttctggccatctctggctctcctcttgacacatattagcttctagcctttgcttccacgacttttatcttttctccaacacatcgcttaccaatcctctctctgctctgttgctttggacttccccacaagaatttcaacgactctcaagtcttttcttccatccccaccactaacctgaatgcctagacccttatttttattaatttccaatagatgctgcctatgggctatattgctttagatgaacattagatatttaaagctcaagaggttcaaaatccaactcattatcttctctttctttcacctccctgctcctctccctatattactgattgcactgaacagcatggtccccaatgtagccatgcaaatgagaaacccagtggctccttgtggtacatgcatgcaagactgctgaagccagaaggatgactgattacgcctcatgggtggaggggaccactcctgggccttcgtgattgtcaggagcaagacctgagatgctccctgccttcagtgtcctctgcatctcccctttctaatgaagatccatagaatttgctacatttgagaattccaattaggaactcacatgttttatctgccctatcaattttttaaacttgctgaaaattaagttttttcaaaatctgtccttgtaaattactttttcttacagtgtcttggcatactatatcaactttgattctttgttacaacttttcttactcttttatcaccaaagtggcttttattctctttattattattattttcttttactactatattacgttgttattattttgttctctatagtatcaatttatttgatttagtttcaatttatttttattgctgacttttaaaataagtgattcggggggtgggagaacaggggagggagagcattaggacaaatacctaatgcatgtgggacttaaaacctagatgatgggttgataggtgcagcaaaccactatggcacacgtatacctgtgtaacaaacctacacattctgcacatgtatcccagaacgtaaagtaaaatttaaaaaaaagtgatcctttgccatgtttgttagcctttttctacatacagtagttcacttttccacttataaatttatttttttaaggtagaaaattgcacacatcgcacaygctcmtccctttgtctccatagccaaagacactgctttgctccagtcctgcagcagcttcaacctggcctgttaatagcaatggcctccacgatgctttcatggtcactagacagtcctctccaatcccgcytcccactgcccacaggagaaagccccgtctagttgcacagtgccgaaggccttagagcccagctcctcccgacttcctctcctgtgaccgcagcttccggccctgtctgtgctgccgcagcttcccacatctccatggtcaccaagcgttccttcccacacatggcctcggaacattccctgtctaggatgccttttccccctttcttccacctagcttctccatcctttaagattcggctcaagagtccctgacttctgaagccattaccagcaactaaagttctttgtgccctcacctggttttctaatatttgtcaatagactatgagagccttataactcacaggacctatttctttgaaagatttgtgtctcctaaagacatggcatttcctaggtaataatttccctagttttactgaagacataagagtcaaaacaccatcaagcaaccatcagatgttaactcaccaaacagatatattctagtcgaaagaaacatctcttaccgtggctagagttaccacaagtaaatgattgtgaattcagttgatagttattatatatactggacattaaactcacaaaccactactttcctctttgtaaacttcttaaggtgcactgtagcacagtggtcccaggcatgcatttggagccagagttcctggattgaaaggcgtctctattcaccagccatgtgcccttggggaaaagctcaatcctgctcatctgtaaaatgggggtgttgacaacaatgacagtgtgtggcaagtattgaataaatgcacaaagagcacttaaagcagtgcttgacacaacttaaacatttgaaatttgttcattatcatcactattccaatttgacaatgaagacaacctgagtggggccacatctggtgactggagatggcagagatcacaaatcttataagaagagagagagactcatatttgcaagtagagagaaactaattaattcttgacacctggttagcactcaaaacaggtctggttcatggaattaaatgagtcaggtcccaatctgtgtctctgttttattaatgtgaatctcaggaaagggtatgtatataagcttcaagatggagttaaggtagctctatcctggctgtgccttgttaggaagagcaagtatcatacaaactctcaaggatccttctctcccagggaagactcgtgggagggagggcctagtaggagcttgaggtatttcctcataattttcttcagcctccaccctcatattttcagatggacaatagatatgtttacatttttgtgaaaagtactttgcatgcacagcttcaagacaagccccttcaagtatttatattgccaycttgagccaatataaaaatcaagaaacttcaccttccagataattcctcctgctttgatagtgttttacctgtgacgatgggcttcatatccactgacctttcaaacatcatgactctttgatgtaaccatagcaatcactattattcccattttacaaaagaagaaatggggcttgaagaggttttgacttgctgaagtttatggcactagtagatcatggagccaagactcgactcccagactgtaaatctctcatccagtggtcttctcactgtatccagsaatcacaccttctttccaaataaaagctgttactctagggggctccaatgtggaggcctctcctctgcaaatagcacttggtggatcagcagcaatattcaaaacagagacgactactggcacatgcagcttccctagaaggccctccattaggagtcgaccaaggagcaaggtaggaactcttcaattagataccaccaagcatccccgcaaggtttccccacacrcttatggctgggagacagggctatggtcagtgaggagagttttctgcttcaccattgattaacattctcctgcctgggcctctcctctctcctctcacatcctgaaagtcctgggtgattgacaaccaggaattattgtctacgaatcttcattaacatcttggtggtccctaatgatgcatcagatatggaggggctgggcaggggattcttcttagaggagctcatggccctggttctaagaatgatgcaagaagatcctcagataaatgtgcaaccccctctttatcatgaacaagggtcaaaaagcaaaggtagtaggggtggggccacttctaagttaattaagccttgggaagttgcaacatgaatttccagatgggccaataaaatgcaggaactgataaagagtccttgttccaagggtttgaatgctctttttctccatgaagcttcctctgaaccctccaggctgactttgttcatactccaagtaagcatgcaggtttactagaaggcggttttctaaaagctaggctaccttctgagagcagcttgaggaaagaggccatgtctttgtgtcccaacaattcccatgctagcacatggcccagtttgttgcaataatgaattaatcaatagattatttagtgatatgtcaattatagaaaactacagcacttctagccacagtgacctctagttaactagttaatggggaattttcatgccagtaaaacataagaacatataatcagtcacttctgacatctgtattctcaaatctaagaagcaggccacaataaaactgctactctccctctctctaggtaccatttgatgtagttgccatttgttttgtacccaccagcagtaacccacttcccaccctgactcccaggaaagctgcatttaattaaattaggatcggtgcaggaaaagcaaaggaaaaaagtccacaatagatcttataaaaataagaaggagaaaggttgtgctttctcatattcactgga

SEQ ID NO: 477 - DNA, 50 bp, Artificial
  Synthetic oligonucleotide
taagcatcttagcctctcagggacgtggagaactgacctgtccttgttgt

SEQ ID NO: 478 - DNA, 50 bp, Artificial
  Synthetic oligonucleotide
gcagaatcagtaccactttgctattggattcctcatggggatgcagctgg

SEQ ID NO: 479 - DNA, 50 bp, Artificial
  Synthetic oligonucleotide
ggagcttgaccaagaattgccctgcaaatcctaaggtgccttcagccttt

SEQ ID NO: 480 - DNA, 50 bp, Artificial
  Synthetic oligonucleotide
cttacactgtgttaagtgcccagcatggcagtatggcagcttagaccaac

SEQ ID NO: 481 - DNA, 50 bp, Artificial
  Synthetic oligonucleotide
tctggaataagttgtgagcagatggacttgtaaacgcctaggtgctgagc

SEQ ID NO: 482 - DNA, 50 bp, Artificial
  Synthetic oligonucleotide
tacccagacagtatacaacacagggaccagtggtctgtttccatcttttc

SEQ ID NO: 483 - protein, 901 aa, Homo sapiens [sequence omitted]

SEQ ID NO: 484 - protein, 821 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 485 - protein, 112 aa, Homo sapiens; identical to SEQ ID NO: 331

SEQ ID NO: 486 - protein, 141 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 487 - protein, 165 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLASSRHTAELKEMPPPPALFFQPSPPTPHLPE

SEQ ID NO: 488 - protein, 164 aa, Homo sapiens [sequence omitted]

SEQ ID NO: 489 - protein, 157 aa, Homo sapiens
MQAPRAAPAAPLSYDRRLRGSIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 490 - DNA, 26 bp, Homo sapiens
acactaaaagaacaaacaccttgctc

SEQ ID NO: 491 - DNA, 22 bp, Homo sapiens
tcctcagaaggcacatgaaaga

SEQ ID NO: 492 - DNA, 106 bp, Homo sapiens
acactaaaagaacaaacaccttgctcttcgagatgagacattttgccaagcagttgaccacttagttctcaagaagcaactatctctttcatgtgccttctgagga

SEQ ID NO: 493 - DNA, 20 bp, Homo sapiens
agtgatggagcaaagtgccg

SEQ ID NO: 494 - DNA, 21 bp, Homo sapiens
cagcagctgatgcaaactgag

SEQ ID NO: 495 - DNA, 132 bp, Homo sapiens
agtgatggagcaaagtgccgggatcatgtaccgcaagtcctgtgcatcatcagcggcctgtctcatcgcctctgccgggtaccagtccttctgctccccagggaaactgaactcagtttgcatcagctgctg

SEQ ID NO: 496 - protein, 275 aa, Homo sapiens
MRILQLILLALATGLVGGETRIIKGFECKPHSQPWQAALFEKTRLLCGATLIAPRWLLTAAHCLKPWVSLTSPTHVSPDLSSSNYCLSHLSRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 497 - DNA, 22 bp, Artificial
  Synthetic oligonucleotide
atttccatcctcaactggcaga

SEQ ID NO: 498 - DNA, 16 bp, Artificial
  Synthetic oligonucleotide
tgccctggaacccacg

SEQ ID NO: 499 - DNA, 104 bp, Artificial
  Synthetic oligonucleotide
atttccatcctcaactggcagagatgagagcctggagcattgcagatgccagggacttcacaaatgaaggcacagcatgggaaacctgcgtgggttccagggca

SEQ ID NO: 500 - protein, 504 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 501 - protein, 504 aa, Homo sapiens; identical to SEQ ID NO: 500

SEQ ID NO: 502 - DNA, 21 bp, Artificial
  Synthetic oligonucleotide
gtccttccagtgcaagaccca

SEQ ID NO: 503 - DNA, 16 bp, Artificial
  Synthetic oligonucleotide
tgggcctggcaaagcc

SEQ ID NO: 504 - DNA, 149 bp, Artificial
  Synthetic oligonucleotide
gtccttccagtgcaagacccaaaaccgccagggccacctgtggcctcctcgtcctcggccactagcctgccgtggcccgtggtcatcggcatcccagccggcgctgtcttcatcctgggcaccctgctcctgtggctttgccaggccca

SEQ ID NO: 505 - DNA, 19 bp, Artificial
  Synthetic oligonucleotide
ccgacggctcctacctcaa

SEQ ID NO: 506 - DNA, 21 bp, Artificial
  Synthetic oligonucleotide
ggaagctgtagcccatggtgt

SEQ ID NO: 507 - DNA, 102 bp, Artificial
  Synthetic oligonucleotide
ccgacggctcctacctcaataagctgctcatcacccgtgcccgccaggacgatgcgggcatgtacatctgccttggcgccaacaccatgggctacagcttcc

SEQ ID NO: 508 - DNA, 2277 bp, Homo sapiens
gactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcgcagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggacggtctctgcgatatgataccagctattttgtggagtattttgccttggatctcctgatggagaacggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtcgatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacagacctggtggagaccctggagctgcagaacctgatgctgtgtgcgctgcagaccatctacggagcagaggcgcggaaggagtcacggggcgcgcatgccagggaagactacaaggtgcggattgatgagtacgattactccaagcccatccaggggcaacagaagaagccctttgaggagcactggaggaagcacaccctgtcctttgtggacgttggcactgggaaggtcactctggaatatagacccgtaatcgacaaaactttgaacgaggctgactgtgccaccatcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgag

SEQ ID NO: 509 - DNA, 1536 bp, Homo sapiens
gtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtaaaaaaaaaaaaaaaaaaaaaaaaaaaaaaaaaaa

SEQ ID NO: 510 - DNA, 1331 bp, Homo sapiens
tcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaattt

SEQ ID NO: 511 - DNA, 748 bp, Homo sapiens
gcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgcaaaaaaaaaaaaaaaa

SEQ ID NO: 512 - DNA, 1867 bp, Homo sapiens
ggttcgctgtggcgggcgcctgggccgccggctgtttaacttcgcttccgctggcccatagtgatctttgcagtgacccagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttaaaaaaaaaaaaaaaaaaaaaa

SEQ ID NO: 513 - DNA, 20 bp, Artificial
  Synthetic oligonucleotide
cggtttgctgcggtaatcat

SEQ ID NO: 514 - DNA, 21 bp, Artificial
  Synthetic oligonucleotide
tttcttgctgccagtctggac

SEQ ID NO: 515 - DNA, 122 bp, Artificial
  Synthetic oligonucleotide
cggtttgctgcggtaatcatgaggataagagagccacgaaccacggcactgattttcagttctgggaaaatggtgtgcacaggagccaagagtgaagaacagtccagactggcagcaagaaa

SEQ ID NO: 516 - DNA, 2201 bp, Homo sapiens
cgggatttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgatcagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaaaaaaaaaaaaaaaaaaaaaaaa

SEQ ID NO: 517 - DNA, 19 bp, Artificial
  Synthetic oligonucleotide
atttgggtcgcggttcttg

SEQ ID NO: 518 - DNA, 21 bp, Artificial
  Synthetic oligonucleotide
tgccttgacattctcgatggt

SEQ ID NO: 519 - DNA, 133 bp, Artificial
  Synthetic oligonucleotide
atttgggtcgcggttcttgtttgtggatcgctgtgatcgtcacttgacaatgcagatcttcgtgaagactctgactggtaagaccatcaccctcgaggttgagcccagtgacaccatcgagaatgtcaaggca

SEQ ID NO: 520 - DNA, 50 bp, Homo sapiens
atgcgggcatgtacatctgccttggcgccaacaccatgggctacagcttc

SEQ ID NO: 521 - DNA, 50 bp, Homo sapiens
gggtctggggtgctctcctggtctttgtgtcggcgttcccctccctacct

SEQ ID NO: 522 - DNA, 50 bp, Homo sapiens
aaaaggagacttcggctacccagagaagttcagtgcccagctctactgag

SEQ ID NO: 523 - DNA, 50 bp, Homo sapiens
aaaggctggcatagggggaggtttcccaggtagaagaagaagtgtcagca

SEQ ID NO: 524 - DNA, 50 bp, Homo sapiens
aattaaccctttgagagctggccaggactctggactgattaccccagcct

SEQ ID NO: 525 - DNA, 50 bp, Homo sapiens
atgagagtaacctcacccgtgcactagtttacagagcattcactgcccca

SEQ ID NO: 526 - DNA, 50 bp, Homo sapiens
cagagatgagagcctggagcattgcagatgccagggacttcacaaatgaa

SEQ ID NO: 527 - DNA, 50 bp, Homo sapiens
aaggaccagagtccatgccaagaccacccttcagcttccaaggccctcca

SEQ ID NO: 528 - DNA, 50 bp, Homo sapiens
atcctccagccatgaggctgctctgggggctgatctgggcatccagcttc

SEQ ID NO: 529 - DNA, 50 bp, Homo sapiens
cctgtttgctctgacaccaacttcctaccctctcagcctcaaagtaactc

SEQ ID NO: 530 - DNA, 50 bp, Homo sapiens
gctgaggtgtggccgaggacctgaccatctggaagtgtgaaaatcccctt

SEQ ID NO: 531 - protein, 2 aa, Artificial
  Synthetic peptide
IN

SEQ ID NO: 532 - protein, 48 aa, Artificial
  Synthetic peptide
TACRSRIANSCHSGDSWRNSCFANSDSAALAVSSEESGGQRALTAPRG

SEQ ID NO: 533 - protein, 37 aa, Artificial
  Synthetic peptide
VRGQEDPEGVEDKCVLAQSRGQSKILLGQLSVNTVMV

SEQ ID NO: 534 - protein, 110 aa, Artificial
  Synthetic peptide
MWVLGIAATFCGLFLLPGFALQIQCYQCEEFQLNNDCSSPEFIVNCTVNVQDMCQKEVMEQSAGIMYRKSCASSAACLIASAGSPCRGLAPGREEQRALHKAGAVGGGVR

SEQ ID NO: 535 - protein, 139 aa, Artificial
  Synthetic peptide
SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 536 - protein, 29 aa, Artificial
  Synthetic peptide
SHCVTRLECSGTISAHCNLCLPGSNDHPT

SEQ ID NO: 537 - protein, 5 aa, Artificial
  Synthetic peptide
MWVLG

SEQ ID NO: 538 - protein, 21 aa, Artificial
  Synthetic peptide
DTKRTNTLLFEMRHFAKQLTT

SEQ ID NO: 539 - protein, 27 aa, Artificial
  Synthetic peptide
DRVSLCHEAGVQWNNFSTLQPLPPRLK

SEQ ID NO: 540 - protein, 5 aa, Artificial
  Synthetic peptide
MWVLG

SEQ ID NO: 541 - protein, 8 aa, Artificial
  Synthetic peptide
IQGRCQRL

SEQ ID NO: 542 - protein, 14 aa, Artificial
  Synthetic peptide
TPASHLAMRQHHHH

SEQ ID NO: 543 - protein, 14 aa, Artificial
  Synthetic peptide
WKVHLPKGEGFSSG

SEQ ID NO: 544 - protein, 22 aa, Artificial
  Synthetic peptide
RPHRSLSIQELGEPGPSEGWGG

SEQ ID NO: 545 - protein, 25 aa, Artificial
  Synthetic peptide
DVTLSGPQVTLLPFPCTPAPCSLCS

SEQ ID NO: 546 - protein, 32 aa, Artificial
  Synthetic peptide
SGCKGKQEGGQERTVTGRWTAQEATEGKKGGP

SEQ ID NO: 547 - protein, 17 aa, Artificial
  Synthetic peptide
RAREGVGPGTGGGEGVE

SEQ ID NO: 548 - protein, 56 aa, Artificial [sequence omitted]

SEQ ID NO: 549 - protein, 26 aa, Artificial
  Synthetic peptide
AERQGGAVWHGHRGRHPPEWIPRPAC

SEQ ID NO: 550 - protein, 46 aa, Artificial
  Synthetic peptide
VGAVPGLWRGWVVLRPRACLSPGSTSLGHGDCPGCPVCLLDCLPHH

SEQ ID NO: 551 - protein, 4 aa, Artificial
  Synthetic peptide
SGER

SEQ ID NO: 552 - protein, 17 aa, Artificial
  Synthetic peptide
SMKQTGEAGRAGGRQGG

SEQ ID NO: 553 - protein, 59 aa, Artificial
  Synthetic peptide
QSSHRGPGLTLPRGPAVLVSLGVACSSYRSCTQPVCSDTNFLPSQPQSNSPFPLLLTPS

SEQ ID NO: 554 - protein, 51 aa, Artificial
  Synthetic peptide
SADVLCFTGHQVRADSWPPCVLLKSASVLRGSALASVAPWSGVCRTRMATG

SEQ ID NO: 555 - protein, 64 aa, Artificial
  Synthetic peptide
ETEGLGRGSGGGMAGAPPTLSDGFPNFREVPSPASRPGAGSAGRGWLQDEVCLLLPPCGVRLPG

SEQ ID NO: 556 - protein, 98 aa, Artificial
  Synthetic peptide
ETEGLGRGSGGGMAGAPPTLSDGFPNFREVPSPASRPGAGSAGRGWLQDEVCLLLPPCGVRSVFPPRPWPDPPSGTGCFGLSGCSLLLLQVMHAACLL

SEQ ID NO: 557 - protein, 21 aa, Artificial
  Synthetic peptide
RNPVRLLQPRAQMFCVLRGTK

SEQ ID NO: 558 - protein, 25 aa, Artificial
  Synthetic peptide
DVTLSGPQVTLLPFPCTPAPCSLCS

SEQ ID NO: 559 - protein, 7 aa, Artificial
  Synthetic peptide
VSSRGEG

SEQ ID NO: 560 - protein, 27 aa, Artificial
  Synthetic peptide
AGEWTEPHFPLKGRVPGRPGEAEYGHY

SEQ ID NO: 561 - protein, 4 aa, Artificial
  Synthetic peptide
SGER

SEQ ID NO: 562 - protein, 38 aa, Artificial
  Synthetic peptide
WAPGAALGQGREGRTQAGAGLLEPAQAEPGRQLTRLHR

SEQ ID NO: 563 - protein, 14 aa, Artificial
  Synthetic peptide
VWSATQGNPLCPRY

SEQ ID NO: 564 - protein, 51 aa, Artificial
  Synthetic peptide
ALGVRQLVGGGHSSRFSHLVVAGLPHACHRKSGSSSQVLCPEPSALLSVAG

SEQ ID NO: 565 - protein, 24 aa, Artificial
  Synthetic peptide
ELGFPSSTGRDESLEHCRCQGLHK

SEQ ID NO: 566 - protein, 11 aa, Artificial
  Synthetic peptide
TTGVSTPAPGV

SEQ ID NO: 567 - protein, 15 aa, Artificial
  Synthetic peptide
VRPCLPVPLLLCWPL

SEQ ID NO: 568 - protein, 11 aa, Artificial
  Synthetic peptide
TTGVSTPAPGV

SEQ ID NO: 569 - protein, 28 aa, Artificial
  Synthetic peptide
GSMKSISEFLVLLSELKWMMLSKFVLKI

SEQ ID NO: 570 - protein, 12 aa, Artificial
  Synthetic peptide
DVPHPWVWKMER

SEQ ID NO: 571 - protein, 16 aa, Artificial
  Synthetic peptide
SKSEYYFCSSVFHSCG

SEQ ID NO: 572 - protein, 72 aa, Artificial
  Synthetic peptide
TTTFPRVIMQEVEHALSSGIPPMEDFWTTMTTGPGETTTTLCTMTPNNGIWPGMRINCSLFISAYPVELIST

SEQ ID NO: 573 - protein, 80 aa, Artificial
  Synthetic peptide
GARLPRHATPCWCPDPPPGPGVPPTGWGPTLPSRAVLARSSAEGGQPRGTVSTAPGMGLGCSPGLCVGVPLPTSFPLALA

SEQ ID NO: 574 - protein, 221 aa, Artificial
  Synthetic peptide
TQNRQGHLWPPRPRPLACRGPWSSASQPALSSSWAPCSCGFARPRRSRAPPRLPLPCLGTARRGRPATAAETRTFPRWPPSALALVWGCVRSMGLRQPPSTYWAQAQLLALSCTPNSTQTSTHTHTHTLTHTHTWRARSTSTSTISARRHRICSGHGGAGQTGRLGGWRTELQTKAGDPWRGGMASTPGSLCVRHSPWTHTHRHTHYLDACMHTHARTRAP

SEQ ID NO: 575 - protein, 40 aa, Artificial
  Synthetic peptide
EEEVSADQVSVGASGVLGSFKEARNAPSFLSWSFSMGPSK

What is claimed is:

1. An isolated polynucleotide consisting of the sequence of R11723_PEA_1_T5 (SEQ ID NO:9).

2. The isolated polynucleotide of claim 1, comprising a node consisting of the sequence of: R11723_PEA_1_node_13 (SEQ ID NO:90).

3. An amplicon consisting of the sequence of SEQ ID NO:492.

4. A primer pair, comprising pair of isolated oligonucleotides to amplify said ampicon of claim 3, said pair of isolated oligonucleotides consisting of the sequences of SEQ ID NOs. 490 and 491.

* * * * *